US011241505B2

(12) United States Patent
Angel et al.

(10) Patent No.: US 11,241,505 B2
(45) Date of Patent: Feb. 8, 2022

(54) NUCLEIC ACID PRODUCTS AND METHODS OF ADMINISTRATION THEREOF

(71) Applicant: Factor Bioscience Inc., Cambridge, MA (US)

(72) Inventors: Matthew Angel, Cambridge, MA (US); Christopher Rohde, Cambridge, MA (US)

(73) Assignee: FACTOR BIOSCIENCE INC., Cambridge, MA (US)

( * ) Notice: Subject to any disclaimer, the term of this patent is extended or adjusted under 35 U.S.C. 154(b) by 0 days.

(21) Appl. No.: 15/550,280

(22) PCT Filed: Feb. 16, 2016

(86) PCT No.: PCT/US2016/018065
§ 371 (c)(1),
(2) Date: Aug. 10, 2017

(87) PCT Pub. No.: WO2016/131052
PCT Pub. Date: Aug. 18, 2016

(65) Prior Publication Data
US 2018/0256748 A1    Sep. 13, 2018

Related U.S. Application Data

(60) Provisional application No. 62/289,617, filed on Feb. 1, 2016, provisional application No. 62/245,726, filed on Oct. 23, 2015, provisional application No. 62/242,383, filed on Oct. 16, 2015, provisional application No. 62/195,462, filed on Jul. 22, 2015, provisional application No. 62/116,232, filed on Feb. 13, 2015.

(51) Int. Cl.
| | |
|---|---|
| *A61K 48/00* | (2006.01) |
| *A61M 37/00* | (2006.01) |
| *C07K 14/00* | (2006.01) |
| *A61K 31/7115* | (2006.01) |
| *C12N 15/88* | (2006.01) |
| *A61P 17/10* | (2006.01) |
| *A61P 17/06* | (2006.01) |
| *A61K 9/00* | (2006.01) |
| *A61K 38/02* | (2006.01) |
| *A61K 38/00* | (2006.01) |

(52) U.S. Cl.
CPC .......... *A61K 48/005* (2013.01); *A61K 9/0019* (2013.01); *A61K 31/7115* (2013.01); *A61K 38/02* (2013.01); *A61M 37/00* (2013.01); *A61M 37/0015* (2013.01); *A61P 17/06* (2018.01); *A61P 17/10* (2018.01); *C07K 14/00* (2013.01); *C12N 15/88* (2013.01); *A61K 38/00* (2013.01); *A61K 2300/00* (2013.01); *A61K 2800/20* (2013.01); *A61M 2037/0007* (2013.01); *A61M 2037/0023* (2013.01)

(58) Field of Classification Search
CPC .................................................. A61K 48/005
See application file for complete search history.

(56) References Cited

U.S. PATENT DOCUMENTS

| | | | |
|---|---|---|---|
| 3,539,465 | A | 11/1970 | Jensen et al. |
| 5,843,780 | A | 12/1998 | Thomson |
| 7,276,489 | B2 | 10/2007 | Agrawal et al. |
| 7,442,548 | B2 | 10/2008 | Thomson et al. |
| 7,449,334 | B2 | 11/2008 | Thomson et al. |
| 7,621,606 | B2 | 11/2009 | Page et al. |
| 7,682,828 | B2 | 3/2010 | Jaenisch et al. |
| 7,687,266 | B2 | 3/2010 | Chambers et al. |
| 7,812,000 | B2 | 10/2010 | Agrawal et al. |
| 8,048,675 | B1 | 11/2011 | Irian |
| 8,048,999 | B2 | 11/2011 | Yamanaka et al. |
| 8,058,065 | B2 | 11/2011 | Yamanaka et al. |
| 8,071,369 | B2 | 12/2011 | Jaenisch et al. |
| 8,129,187 | B2 | 3/2012 | Yamanaka et al. |
| 8,129,348 | B2 | 3/2012 | Besman et al. |
| 8,202,850 | B2 | 6/2012 | Agrawal et al. |
| 8,278,036 | B2 | 10/2012 | Kariko et al. |
| 8,420,782 | B2 | 4/2013 | Bonas et al. |
| 8,440,431 | B2 | 5/2013 | Voytas et al. |
| 8,440,432 | B2 | 5/2013 | Voytas et al. |

(Continued)

FOREIGN PATENT DOCUMENTS

| | | |
|---|---|---|
| CN | 101200758 | 6/2008 |
| EP | 2241572 | 10/2010 |

(Continued)

OTHER PUBLICATIONS

Pastore et al. (Jan. 2015, Brit. J. Pharmacology, vol. 172, pp. 2179-2209). (Year: 2015).*
Mali et al. (Feb. 2013, Science, vol. 339(6121), pp. 823-826) (Year: 2013).*
Wang et al. (2013, Cell, vol. 153(4), pp. 910-918). (Year: 2013).*
Wu et al. (2014, Quant. Biol., vol. 2(2), pp. 59-70) (Year: 2014).*
Ran et al. (2013, Cell, vol. 154, pp. 1380-1389) (Year: 2013).*
Albumax I product insert, Invitrogen Corporation, 1 page (2001).
Anderson et al., "Incorporation of pseudouridine into mRNA enhances translation by diminishing PKR activation," Nucl. Acids Res. 38(17): 5884-5892 (2010).
Anderson et al., "Nucleofection induces transient eiF2a phosphorylation by GCN2 and PERK," Gene Ther., pp. 1-7 (2012).

(Continued)

*Primary Examiner* — Thaian N. Ton
*Assistant Examiner* — David A Montanari
(74) *Attorney, Agent, or Firm* — Wilson Sonsini Goodrich & Rosati

(57) ABSTRACT

The present invention relates in part to nucleic acids, including nucleic acids encoding proteins, therapeutics and cosmetics comprising nucleic acids, methods for delivering nucleic acids to cells, tissues, organs, and patients, methods for inducing cells to express proteins using nucleic acids, methods, kits and devices for transfecting, gene editing, and reprogramming cells, and cells, organisms, therapeutics, and cosmetics produced using these methods, kits, and devices.

26 Claims, 33 Drawing Sheets
Specification includes a Sequence Listing.

(56) References Cited

U.S. PATENT DOCUMENTS

| | | |
|---|---|---|
| 8,450,471 B2 | 5/2013 | Voytas et al. |
| 8,470,973 B2 | 6/2013 | Bonas et al. |
| 8,586,526 B2 | 11/2013 | Gregory et al. |
| 8,691,966 B2 | 4/2014 | Kariko et al. |
| 8,710,200 B2 | 4/2014 | Schrum et al. |
| 8,716,465 B2 | 5/2014 | Rossi et al. |
| 8,748,089 B2 | 6/2014 | Kariko et al. |
| 8,802,438 B2 | 8/2014 | Rossi et al. |
| 8,822,663 B2 | 9/2014 | Schrum et al. |
| 8,835,108 B2 | 9/2014 | Kariko et al. |
| 8,883,506 B2 | 11/2014 | Rossi et al. |
| 9,376,669 B2 | 6/2016 | Angel et al. |
| 9,447,395 B2 | 9/2016 | Angel et al. |
| 9,464,285 B2 | 10/2016 | Angel et al. |
| 9,487,768 B2 | 11/2016 | Angel et al. |
| 2003/0009148 A1 | 1/2003 | Hayakawa |
| 2003/0083272 A1 | 5/2003 | Wiederholt et al. |
| 2003/0228658 A1 | 12/2003 | Shu et al. |
| 2005/0053588 A1 | 3/2005 | Yin |
| 2005/0130144 A1 | 6/2005 | Nakatsuji et al. |
| 2005/0192357 A1 | 9/2005 | Arai et al. |
| 2005/0272634 A1 | 12/2005 | Bahlmann et al. |
| 2007/0134796 A1 | 6/2007 | Holmes et al. |
| 2008/0009785 A1 | 1/2008 | Mikszta et al. |
| 2008/0213377 A1 | 9/2008 | Bhatia et al. |
| 2008/0233610 A1 | 9/2008 | Thomson et al. |
| 2008/0260706 A1 | 10/2008 | Rabinovich et al. |
| 2009/0029465 A1 | 1/2009 | Thomson et al. |
| 2009/0093433 A1 | 4/2009 | Woolf et al. |
| 2009/0275128 A1 | 11/2009 | Thomson et al. |
| 2009/0286852 A1 | 11/2009 | Kariko et al. |
| 2010/0003757 A1 | 1/2010 | Mack et al. |
| 2010/0047261 A1 | 2/2010 | Hoerr et al. |
| 2010/0075421 A1 | 3/2010 | Yamanka et al. |
| 2010/0076057 A1 | 3/2010 | Sontheimer et al. |
| 2010/0120079 A1 | 5/2010 | Page et al. |
| 2010/0144031 A1 | 6/2010 | Jaenisch et al. |
| 2010/0167286 A1 | 7/2010 | Reijo Pera et al. |
| 2010/0168000 A1 | 7/2010 | Kiessling et al. |
| 2010/0172882 A1 | 7/2010 | Glazer et al. |
| 2010/0184033 A1 | 7/2010 | West et al. |
| 2010/0184227 A1 | 7/2010 | Thomson et al. |
| 2010/0221829 A1 | 9/2010 | Amity et al. |
| 2010/0233804 A1 | 9/2010 | Zhou et al. |
| 2010/0267141 A1 | 10/2010 | Shi et al. |
| 2010/0272695 A1 | 10/2010 | Agulnick et al. |
| 2010/0273220 A1 | 10/2010 | Yanki et al. |
| 2010/0304481 A1 | 12/2010 | Thomson et al. |
| 2010/0311171 A1 | 12/2010 | Nakanishi et al. |
| 2010/0317104 A1 | 12/2010 | Elefanty et al. |
| 2011/0045001 A1 | 2/2011 | Klosel et al. |
| 2011/0065103 A1 | 3/2011 | Sahin et al. |
| 2011/0076678 A1 | 3/2011 | Jaenisch et al. |
| 2011/0104125 A1 | 5/2011 | Yu |
| 2011/0110899 A1 | 5/2011 | Shi et al. |
| 2011/0143397 A1 | 6/2011 | Kariko et al. |
| 2011/0143436 A1 | 6/2011 | Dahl et al. |
| 2011/0145940 A1 | 6/2011 | Voytas et al. |
| 2011/0151557 A1 | 6/2011 | Reh et al. |
| 2011/0165133 A1 | 7/2011 | Rabinovich et al. |
| 2011/0171185 A1 | 7/2011 | Klimanskaya et al. |
| 2011/0189137 A1 | 8/2011 | Rana et al. |
| 2011/0021335 A1 | 9/2011 | Burton et al. |
| 2011/0213335 A1 | 9/2011 | Burton et al. |
| 2011/0236978 A1 | 9/2011 | Stolzing et al. |
| 2011/0239315 A1 | 9/2011 | Bonas et al. |
| 2011/0244566 A1 | 10/2011 | Wu et al. |
| 2011/0263015 A1 | 10/2011 | D'Costa et al. |
| 2011/0301073 A1 | 12/2011 | Gregory et al. |
| 2012/0046346 A1 | 2/2012 | Rossi et al. |
| 2012/0064620 A1 | 3/2012 | Bonas et al. |
| 2012/0192301 A1 | 7/2012 | Jaenisch et al. |
| 2012/0195936 A1 | 8/2012 | Rudolph et al. |
| 2012/0202291 A1 | 8/2012 | Chen et al. |
| 2012/0208278 A1 | 8/2012 | Yanik et al. |
| 2012/0237975 A1 | 9/2012 | Schrum et al. |
| 2012/0301455 A1 | 11/2012 | Hunt |
| 2013/0040302 A1 | 2/2013 | Burke et al. |
| 2013/0071365 A1 | 3/2013 | Suzuki |
| 2013/0102034 A1 | 4/2013 | Schrum et al. |
| 2013/0115272 A1 | 5/2013 | de Fougerolles et al. |
| 2013/0122581 A1 | 5/2013 | Voytas et al. |
| 2013/0123481 A1 | 5/2013 | de Fougerolles et al. |
| 2013/0156849 A1 | 6/2013 | de Fougerolles et al. |
| 2013/0165504 A1 | 6/2013 | Bancel et al. |
| 2013/0189327 A1 | 7/2013 | Ortega et al. |
| 2013/0189741 A1 | 7/2013 | Meis et al. |
| 2013/0203115 A1 | 8/2013 | Schrum et al. |
| 2013/0217119 A1 | 8/2013 | Bonas et al. |
| 2013/0244282 A1 | 9/2013 | Schrum et al. |
| 2013/0245103 A1 | 9/2013 | de Fougerolles et al. |
| 2013/0274129 A1 | 10/2013 | Katzen et al. |
| 2013/0302295 A1 | 11/2013 | Wang et al. |
| 2013/0345274 A1 | 12/2013 | Farber |
| 2014/0073053 A1 | 3/2014 | Yanik et al. |
| 2014/0073687 A1 | 3/2014 | Chien et al. |
| 2014/0127814 A1 | 5/2014 | Chandrasegaran et al. |
| 2014/0194482 A1 | 7/2014 | Farber et al. |
| 2014/0242154 A1 | 8/2014 | Ramunas et al. |
| 2014/0242155 A1 | 8/2014 | Ramunas et al. |
| 2014/0242595 A1 | 8/2014 | Yu et al. |
| 2014/0315988 A1 | 10/2014 | Dahl et al. |
| 2014/0349401 A1 | 11/2014 | Wang et al. |
| 2014/0356906 A1 | 12/2014 | Angel et al. |
| 2015/0275193 A1 | 10/2015 | Angel et al. |
| 2016/0185861 A1 | 6/2016 | Bedoya et al. |

FOREIGN PATENT DOCUMENTS

| | | |
|---|---|---|
| EP | 2272961 | 1/2011 |
| EP | 2320952 | 5/2011 |
| JP | 2003306448 | 10/2003 |
| JP | 2010246551 | 11/2010 |
| JP | 2011160661 | 8/2011 |
| WO | WO 199800551 | 1/1998 |
| WO | WO 1998030679 | 7/1998 |
| WO | WO 2000074763 | 12/2000 |
| WO | WO 2002026757 | 4/2002 |
| WO | WO 2002094251 | 11/2002 |
| WO | WO 2003086472 | 10/2003 |
| WO | WO 2007006808 | 1/2007 |
| WO | WO 2007024708 | 3/2007 |
| WO | WO 2008065381 | 6/2008 |
| WO | WO 2009006930 | 1/2009 |
| WO | WO 2009077134 | 6/2009 |
| WO | WO 2009127230 | 10/2009 |
| WO | WO 2009147400 | 12/2009 |
| WO | WO 2010012472 | 2/2010 |
| WO | WO 2010093655 | 8/2010 |
| WO | WO 2010123501 | 10/2010 |
| WO | WO 2010148050 | 10/2010 |
| WO | WO 2010130447 | 11/2010 |
| WO | WO 2011134210 | 3/2011 |
| WO | WO 2011071931 | 6/2011 |
| WO | WO 2011071936 | 6/2011 |
| WO | WO 2011072246 | 6/2011 |
| WO | WO 2011110886 | 9/2011 |
| WO | WO 2011114237 | 9/2011 |
| WO | WO 2011012316 | 10/2011 |
| WO | WO 2011130624 | 10/2011 |
| WO | WO 2011140397 | 11/2011 |
| WO | WO 2011141820 | 11/2011 |
| WO | WO 2011146121 | 11/2011 |
| WO | WO 2011154393 | 12/2011 |
| WO | WO 2011159369 | 12/2011 |
| WO | WO 2012019122 | 2/2012 |
| WO | WO 2012019168 | 2/2012 |
| WO | WO 2012036299 | 3/2012 |
| WO | WO 2012048213 | 4/2012 |
| WO | WO 2012060473 | 5/2012 |
| WO | WO 2012122318 | 9/2012 |
| WO | WO 2012131090 | 10/2012 |
| WO | WO 2012138453 | 10/2012 |
| WO | WO 2012138939 | 10/2012 |

(56) References Cited

FOREIGN PATENT DOCUMENTS

| WO | WO 2012174224 | 12/2012 | | |
|---|---|---|---|---|
| WO | WO 2012176015 | 12/2012 | | |
| WO | WO 2013003475 | 1/2013 | | |
| WO | WO 2013020064 | 2/2013 | | |
| WO | WO 2013053819 | 4/2013 | | |
| WO | 2013078199 | 5/2013 | | |
| WO | WO 2013078199 | 5/2013 | | |
| WO | WO 2013086008 | 6/2013 | | |
| WO | WO 2013102203 | 7/2013 | | |
| WO | WO 2013151671 | 10/2013 | | |
| WO | WO-2013151671 A1 * | 10/2013 | ........... | A61K 48/005 |
| WO | WO 2013163296 | 10/2013 | | |
| WO | WO 2013173248 | 11/2013 | | |
| WO | WO 2014015314 | 1/2014 | | |
| WO | WO 2014134412 | 9/2014 | | |
| WO | WO 2014190361 | 11/2014 | | |
| WO | WO 2015038075 | 3/2015 | | |
| WO | 2015117021 | 8/2015 | | |
| WO | WO 20150117021 | 8/2015 | | |

OTHER PUBLICATIONS

Anderson et al., "Nucleoside modifications in RNA limit activation of 2'-5'-oligoadenylate synthetase and increase resistance to cleavage by RNase L," Nucl. Acids Res. 39(21):9329-9338 (2011).
Angel et al., "Innate Immune Suppression Enables Frequent Transfection with RNA Encoding Reprogramming Proteins," PLoS ONE, vol. 5(7), e11756, pp. 1-7 (2010).
Angel, "Extended Transient Transfection by Repeated Delivery of an In Vitro-Transcribed RNA," Master of Science in Electrical Engineering and Computer Science, 56 pages (Massachusetts Institute of Technology, Cambridge, Massachusetts;) (2009).
Angel, "Reprogramming Human Somatic Cells to Pluripotency Using RNA", pp. 1-89 (Ph.D. diss., Massachusetts Institute of Technology) (2012).
Angel, "Reprogramming human somatic cells to pluripotency using RNA," Doctor of Philosophy in Electrical Engineering and Computer Science, 55 pages (Massachusetts Institute of Technology, Cambridge, Massachusetts;) (2011).
Arnold et al., "Reprogramming of Human Huntington Fibroblasts Using mRNA," ISRN Cell Biology 2012: Article ID 124878, pp. 1-12 (2012).
Barker et al., "A method for the deionization of bovine serum albumin," Tissue Culture Association, pp. 111-112 (1975).
Berg, "Proposed structure for the zinc-binding domains from transcription factor IIA and related proteins," Proc. Natl. Acad. Sci. USA, vol. 85, pp. 99-102 (1988).
Booh et al., "Breaking the Code of DNA Binding Specificity of TAL-Type III Effectors," Science, vol. 3126, pp. 1509-1512 (2009).
Bogdanove et al., "TAL effectors: customizable proteins for DNA targeting", Science, vol. 333, pp. 1843-1846 (2011).
Bolli et al., "Cardiac stem cells in patients with ischaemic cardiomyopathy (SCIPIO): initial results of a randomized phase 1 trial," Lancet 378:1847-1857 (2011).
Braam et al., "Recombinant vitronectin is a functionally defined substrate that supports human embryonic stem cell self-renewal via αv β5 integrin," Stem Cells 26:2257-2265 (2008).
Carroll, "Progress and prospects: Zinc-finger nucleases as gene therapy agents," Gene Therapy, vol. 15, pp. 1463-1468 (2008).
Chen et al., "Chemically defined conditions for human iPSC derivation and culture," Nat. Methods 8:424-429 (2011).
Chen et al., "Rational optimization of reprogramming culture conditions for the generation of induced pluripotent stem cells with ultra-high efficiency and fast kinetics," Cell Research 21:884-894 (2011).
Chen et al., "Role of MEF feeder cells in direct reprograming of mousetail-tip fibroblasts." Cell Biology International., vol. 33, No. 12., pp. 1268-1273 (2009).
Christian et al., "Targeting DNA Double-Strand Breaks with TAL Effector Nucleases," Genetics, vol. 186, pp. 757-761 (2010).

Cox et al., "Therapeutic Genome Editing: Prospects and Challenges." Nat Med., vol. 21, No. 2 pp. 121-131 (2015).
Cui et al., "Targeted integration in rat and mouse embryos with zinc-finger nucleases," Nat. Biotech., vol. 29, No. 1, pp. 64-67 (2011).
Dang et al., "Mutation analysis and characterization of COL7A1 mutations in dystrophic epidermolysis bullosa." Experimental Dermatology, 17, 553-568 (2008).
Davis, "Stabilization of RNA stacking by pseudouridine," Nucleic Acids Research, vol. 23, No. 24, pp. 5020-5026 (1995).
Deng et al. "Structural Basis for Sequence-Specific Recognition of DNA by TAL Effectors" Science. 335(6069) 720-723 (2012).
Droge et al., "A comparative study of some physico-chemical properties of human serum albumin samples from different sources. Some physico-chemical properties of isoionic human serum albumin solutions," Biochem. Pharmacal. 31, 3775-3779 (1982).
Efe et al., "Conversion of mouse fibroblasts into cardiomyocytes using a direct reprogramming strategy," Nat. Cell Biol. 13:215-222 (2011).
Fritsch et al., "Dominant—negative Effects of COL7A1 Mutations Can be Rescued by Controlled Overexpression of Normal Collagen VII," The Journal of Biological Chemistry, vol. 284, No. 44, pp. 30248-30256, (2009).
Garcia-Gonzalo et al., "Albumin-associated lipids regulate human embryonic stem cell self-renewal," PLoS One 3: e1384, 1-10 (2008).
Geurts et al., "Knockout Rats via Embryo Microinjection of Zinc-Finger Nucleases," Science, vol. 325, p. 433 (2009).
Goldberg et al., "The enzymatic synthesis of pseudouridine triphosphate," Biochim. Biophys. Acta, vol. 54, pp. 202-204 (1961).
Goldberg et al., "The incorporation of 5-ribosyluracil triphosphate into RNA in nuclear extracts of mammalian cells," Biochem. Biophys. Res. Commun. 6, pp. 394-398 (1961).
Goldberg, "Ribonucleic acid synthesis in nuclear extracts of mammalian cells grown in suspension culture; effect of ionic strength and surface-active agents," Biochim. Biophys. Acta, vol. 51, pp. 201-204 (1961).
Goto et al., "Fibroblasts Show More Potential as Target Cells than Keratinocytes in COL7A1 Gene Therapy of Dystrophic Epidermolysis Bullosa", Journal of Investigative Dermatology 126, 766-772 (2006).
Goto et al., "Targeted Skipping of a Single Exon Harboring a Premature Termination Codon Mutation: Implications and Potential for Gene Correction Therapy for Selective Dystrophic Epidermolysis Bullosa Patients," Journal of Investigative Dermatology, vol. 126, pp. 2614-2620, (2006).
"Guidance Notes for the Safe Storage and Handling of Cryogenic Materials", Dec. 2002, pp. 1-32, especially p. 2, [online] Retrieve from the Internet: https://www.st-andrews.ac.uk/staff/policy/healthandsafety/publications/cryogenics-safestorageandhandling/.
Gurung et al., "β-Catenin is a Mediator of the Response of Fibroblasts to Irradiation," The American Journal of Pathology, vol. 174, No. 1, pp. 248-255 (2009).
Hamanaka et al., "Generation of Germline-Component Rat Induced Pluripotent Stem Cells," PlosOne, vol. 6, Issue 7, pp. 1-9 (2011).
Hoban et al. "Correction of the sickle cell disease mutation in human hematopoietic stem/progenitor cells" Blood 125(17):2597-2604 (2015).
Hockemeyer et al., "Efficient targeting of expressed and silent genes in human ESCs and iPSCs using zinc-finger nucleases," Nature Biotechnology, vol. 27, No. 9, pp. 851-857 (2009).
Hockemeyer et al., "Genetic engineering of human ES and iPS cells using TALE nucleases," Author Manuscript, available in PMC Feb. 1, 2012. Published in final edited form as: Nat Biotechnol. 29(8): 731-734 (2012).
International Search Report, PCT/US2012/067966, 5 pages, (dated Apr. 11, 2013).
International Search Report, PCT/US2013/068118, 4 pages, (dated Mar. 27, 2014).
International Search Report, PCT/US2015/13949, 4 pages, (dated May 21, 2015).
International Search Report, PCT/US2017/047440, 5 pages, (dated Nov. 16, 2017).

(56) References Cited

OTHER PUBLICATIONS

Juillerat et al., "Optimized tuning of TALEN specificity using non-conventional RVDs", Sci. Rep., vol. 5:8150, pp. 1-7 (2015).
Kahan et al., "The Role of Deoxyribonucleic Acid in Ribonucleic Acid Synthesis," The Journal of Biological Chemistry, vol. 237, No. 12, pp. 3778-3785 (1962).
Kariko et al., "Generating the optimal mRNA for therapy: HPLC purification eliminates immune activation and improves translation of nucleoside-modified, protein-encoding mRNA," Nucl. Acids Res. 39:e142 (2011).
Kariko et al., "In vivo protein expression from mRNA delivered into adult rat brain," J. Neurosci. Methods 105:77-86 (2001).
Kariko et al., "Incorporation of pseudouridine into mRNA yields superior nonimmunogenic vector with increased translational capacity and biological stability," Mol. Ther. 16:1833-1840 (2008).
Kariko et al., "Increased Erythropoiesis in Mice Injected with Sub-Microgram Quantities of Pseudouridine-containing mRNA Encoding Erythropoietin," Mol. Ther. 20:948-953 (2012).
Kariko et al., "mRNA is an endogenous ligand for Toll-like receptor 3," J. Biol. Chem. 279, pp. 12542-12550 (2004).
Kariko et al., "Naturally occurring nucleoside modifications suppress the immunostimulatory activity of RNA: implication for therapeutic RNA development," Drug Discovery & Development, vol. 10, No. 5, pp. 523-532 (2007).
Kariko et al., "Suppression of RNA recognition by Toll-like receptors: the impact of nucleoside modification and the evolutionary origin of RNA," Immunity 23:165-175 (2005).
Kawamata et al., "Generation of genetically modified rats from embryonic stem cells," PNAS, vol. 107, No. 32, pp. 14223-14228 (2010).
Kern et al., "Mechanisms of Fibroblast Cell Therapy for Dystrophic Epidermolysis Bullosa: High Stability of Collagen VII Favors Long-term Skin Integrity," Molecular Therapy, vol. 17, No. 9, 1605-1615, (2009).
Kim et al., "Direct reprogramming of human neural stem cells by OCT4," Nature 461:649-653 (2009).
Kim et al., "Generation of Human Induced Pluripotent Stem Cells by Direct Delivery of Reprogramming Proteins," Cell Stem Cell 4, pp. 472-476 (2009).
Kim et al., "Hybrid restriction enzymes: Zinc finger fusions to Fok I cleavage domain," Proc. Natl. Acad. Sci. USA, vol. 93, pp. 1156-1160 (1996).
Kim et al., "Oct4-induced pluripotency in adult neural stem cells," Cell 136:411-419 (2009).
Kim et al., "Pluripotent stem cells induced from adult neural stem cells by reprogramming with two factors," Nature 454:646-650 (2008).
Kita, K. et al., "Overproduction and characterization of the StsI restriction endonuclease", Gene,,vol. 169, pp. 69-73 (1996).
Krug et al., "A GMP—compliant protocol to expand and transfect cancer patient T cells with mRNA encoding a tumor-specific chimeric antigen receptor." Cancer Immunol Immunother., pp. 1-10 (2014).
Lee et al., "Activation of Innate Immunity is Required for Efficient Nuclear Reprogramming," Cell 151,547-558 (2012).
Li et al. "Identification and characterization of mitochondrial targeting sequence of human apurinic/apyrimidinic endonuclease 1." Journal of Biological Chemistry, 285(20): 14871-14881 (2010).
Lin et al., "A chemical platform for improved induction of human iPSCs," Nature Methods, vol. 6, No. 11, 805-808 (2009).
Liu et al., "A Small-Molecule Agonist of the Wnt Signaling Pathway," Angew. Chem. Int. Ed. 44, pp. 1987-1990 (2005).
Lu, et al. "Defined culture conditions of human embryonic stem cells" PNAS; 103;5688-5693, (2006).
Ludwig et al., "Derivation of human embryonic stem cells in defined conditions," Nat. Biotechnol. 24:185-187 (2006).
Ludwig et al., "Feeder-independent culture of human embryonic stem cells," Nat. Methods 3:637-646 (2006).
Mahfouz et al., "De novo-engineered transcription activator-like effector (TALE) hybrid nuclease with novel DNA binding specificity creates double-strand breaks," PNAS vol. 108, No. 6, pp. 2623-2628 (2011).
Mayr et al., "Gene Therapy for the COL7A1 Gene" Open access peer-reviewed chapter. https://www.intechopen.com/books/gene-therapy-tools-and-potential-applications/gene-therapy-for-the-col7a1-gene Published Feb. 27, 2013.
Miller et al., "A TALE nuclease architecture for efficient genome editing," Nature Biotechnology, vol. 29, No. 2, pp. 143-148 (2011).
Miller et al., "An improved zinc-finger nuclease architecture for highly specific genome editing," Nat. Biotechnol.; vol. 25, No. 7, pp. 778-785 (2007).
MIT Thesis Record, "Reprogramming human somatic cells to pluripotency using RNA," (Matthew Angel, author), (2012).
Moscou et al., "A Simple Cipher Governs DNA Recognition by TAL Effectors," Science, vol. 326, p. 1501 (2009).
Murauer et al., "Functional Correction of Type VII Collagen Expression in Dystrophic Epidermolysis Bullosa," Journal of Investigative Dermatology, vol. 131, pp. 74-83, (2011).
Ng et al., "A protocol describing the use of a recombinant protein-based, animal product-free medium (APEL) for human embryonic stem cell differentiation as spin embryoid bodies," Nat. Protoc. 3:768-776 (2008).
Niu et al., "Engineering Variants of the I-SceI Homing Endonuclease with Strand-specific and Site-specific DNA-nicking Activity, Journal of Molecular Biology" vol. 382, pp. 188-202 (2008).
Okita et al., "Generation of germline-competent induced pluripotent stem cells," Nature, vol. 448, pp. 313-317 (2007).
Osborn et al., "Talen-based Gene Correction for Epidermolysis Bullosa," Molecular Therapy vol. 21, No. 6, pp. 1151-1159, (2013).
Ousterout et al., Genetic Correction of Dystrophin by Engineered Nucleases, Mol. Ther., vol. 20, pp. S26-27 (2012).
P29346, Uniprot [online], Jan. 23, 2007, [retrieved on Sep. 27, 2017], URL, http://www.uniprot.org/uniprot/P29346.
P60568, UniprotKB, IL2-Human, Jul. 21, 1986.
Plews et al., "Activation of pluripotency genes in human fibroblast cells by a novel mRNA based approach," PLoS One 5:e14397 (2010).
Porteus et al., "Gene targeting using zinc finger nucleases," Nat. Biotechnol., vol. 23, No. 8, pp. 967-973 (2005).
Potter et al., "Transfection by Electroporation," Curr Protoc Mol Biol., Chapter: Unit-.3. doi:10.1002-0471142727.mb0903s62, pp. 1-12,(2003).
Remington et al., "Injection of recombinant human type VII collagen corrects the disease phenotype in a murine model of dystrophic epidermolysis bullosa", Molecular Therapy, vol. 17, No. 1, pp. 26-33, (2009).
Rossi et al., "Anti-inflammatory cyclopentenone prostaglandins are direct inhibitors of IκB kinase," Nature, vol. 403, pp. 103-108 (2000).
Sander et al., "Targeted gene disruption in somatic zebrafish cells using engineered TALENs," Author Manuscript, available in PMC on Feb. 5, 2012. Published in final edited form as: Nat Biotechnol; 29(8): 697-698 (2012).
Sanjana et al., "A transcription activator-like effector toolbox for genome engineering," Nature Protocols, vol. 7, No. 1, pp. 171-192 (2012).
Schneider, "An Effective Method for Defatting Albumin Using Resin Columns," Biochim. Biophys. Acta, 221, 376-378, (1970).
Schwartz et al., "Embryonic stem cell trials for macular degeneration: a preliminary report," Lancet 379:713-720 (2012).
Sebastiano et al. "In Situ Genetic Correction of the Sickle Cell Anemia Mutation in Human Induced Pluripotent Stem Cells Using Engineered Zinc Finger Nucleases" Stem Cells 29:1717-1726, (2011).
Shimizu et al., "Transformation by Wnt Family Proteins Correlates with Regulation of β-Catenin," Cell Growth & Differentiation, vol. 8, pp. 1349-1358 (1997).
Soldner et al., "Generation of isogenic pluripotent stem cells differing exclusively at two early onset Parkinson point mutations," Author Manuscript, available in PMC on Jul. 22, 2012. Published in final edited form as: Cell. Jul. 22, 2011; 146(2): 318-331 (2011).

(56) References Cited

OTHER PUBLICATIONS

Sugii et al., "Human and mouse adipose-derived cells support feeder—independent induction of pluripotent stem cells." PNAS, vol. 107, No. 8, pp. 2558-2563 (2010).
Sun and Zhao. "Seamless correction of the sickle cell disease mutation of the HBB gene in human induced pluripotent stem cells using TALENs" Biotechnology and Bioengineering 111(5):1048-1053 (2014).
Takahashi and Yamanaka "Induction of pluripotent stem cells from mouse embryonic and adult fibroblast cultures by defined factors," Cell 126:663-676 (2006).
Takahashi et al., "Induction of pluripotent stem cells from adult human fibroblasts by defined factors," Cell 131:861-872 (2007).
Tesson et al., "Knockout rats generated by embryo microinjection of TALENs," Nature Biotechnology, vol. 29, No. 8, pp. 695-696 (2011).
Titeux et al., "Gene Therapy for Recessive Dystrophic Epidermolysis Bullosa," Dermatologic Clinics, vol. 28, pp. 361-366, (2010).
Tolar, et al., "Patient-Specific Naturally Gene-Reverted Induced Pluripotent Stem Cells in Recessive Dystrophic Epidermolysis Bullosa," Journal of Investigative Dermatology, vol. 134, pp. 1246-1254, (2014).
Wally et al., "Spliceosome-Mediated Trans-Splicing: The Therapeutic Cut and Paste," Journal of Investigative Dermatology, vol. 132, pp. 1959-1966, (2012).
Warren et al., "Highly efficient reprogramming to pluripotency and directed differentiation of human cells with synthetic modified mRNA," Cell. Stem Cell 7:618-630 (2010).
Watanabe et al., "A ROCK inhibitor permits survival of dissociated human embryonic stem cells," Nature Biotechnology, vol. 25, No. 6, pp. 681-686 (2007).
Wei, et al., "An Electroporation Chip Based on Flexible Microneedle Array for In Vivo Nucleic Acid Delivery," MEMS, 2014, San Francisco, CA, USA, pp. 817-820, (2014).
Wernig et al., "In vitro reprogramming of fibroblasts into a pluripotent ES-cell-like state," Nature, vol. 448, pp. 317-324 (2007).
Wong, et al., "Potential of Fibroblast Cell Therapy for Recessive Dystrophic Epidermolysis Bullosa", Journal of Investigative Dermatology (2008) 128, 2179-2189.
Wood et al., "Targeted Genome Editing Across Species Using ZFNs and TALENs," Science, vol. 333, p. 307 (2011).
Woodley et al., "Intradermal injection of lentiviral vectors corrects regenerated human dystrophic epidermolysis bullosa skin tissue in vivo". Mol Ther; 10(2):318-26(2004).
"Xeno-Free System for hESC & hiPSC. Facilitating the Shift from Stem Cell Research to Clinical Applications." 12 pages, Biological Industries Catalog (Stem Cell Products) (2011).
Xie et al., "Newly expressed proteins of mouse embryonic fibroblasts irradiated to be inactive," Biochem. Biophys. Res. Commun. 315, pp. 581-588 (2004).
Yakubov et al., "Reprogramming of human fibroblasts to pluripotent stem cells using mRNA of four transcription factors," Biochem. Biophys. Res. Commun. 394:189-193 (2010).
You et al., "Wnt signaling promotes oncogenic transformation by inhibiting c-Myc-induced apoptosis," The Journal of Cell Biology, vol. 157, No. 3, pp. 429-440 (2002).
Young et al., "Background Mutations in Parental Cells Account for Most of the Genetic Heterogeneity of Induced Pluripotent Stem Cells," Cell Stem Cell 10, pp. 570-582 (2012).
Yu et al., "Induced pluripotent stem cell lines derived from human somatic cells," Science 318:1917-1920 (2007).
Zhou et al., "Generation of Induced Pluripotent Stem Cells Using Recombinant Proteins," Cell Stem Cell 4, pp. 1-4 (2009).
Database UniProtKB, P60568 (IL2-HUMAN), Jul. 21, 1986.
Guidance Notes for the Safe Storage and Handling of Cryogenic Materials, Dec. 2002, pp. 1-32, especially p. 2, [online] Retrieve from the Internet: <URL:https://www.st-andrews.ac.uldstaff/policy/healthandsafety/publications/cryogenics-safestorageandhandling/#5-7.

* cited by examiner

| A1, A2 | EPO Standard, 100 mU/mL |
| B1, B2 | EPO Standard, 50 mU/mL |
| C1, C2 | EPO Standard, 25 mU/mL |
| D1, D2 | EPO Standard, 12.5 mU/mL |
| E1, E2 | EPO Standard, 6.25 mU/mL |
| F1, F2 | EPO Standard, 3.12 mU/mL |
| G1, G2 | EPO Standard, 1.56 mU/mL |
| H1, H2 | EPO Standard, 0 mU/mL |
| A3, A4 | EPO RNA (A, G, U, C), 24h |
| B3, B4 | EPO RNA (A, G, 5 moU, C), 24h |
| C3, C4 | EPO RNA (A, G, psU, C), 24h |
| D3, D4 | GFP RNA, 24h |
| E3, E4 | untransfected, 24h |
| F3, F4 | 1:100 EPO RNA (A, G, U, C), 24h |
| G3, G4 | 1:100 EPO RNA (A, G, 5 moU, C), 24h |
| H3, H4 | 1:100 EPO RNA (A, G, psU, C), 24h |

| A1 | EPO Standard, 100 mU/mL |
| B1 | EPO Standard, 50 mU/mL |
| C1 | EPO Standard, 25 mU/mL |
| D1 | EPO Standard, 12.5 mU/mL |
| E1 | EPO Standard, 6.25 mU/mL |
| F1 | EPO Standard, 3.12 mU/mL |
| G1 | EPO Standard, 1.56 mU/mL |
| H1 | EPO Standard, 0 mU/mL |
| A2 | 1:100 EPO RNA (A, G, 5 moU, C), 24h |
| B2 | 1:500 EPO RNA (A, G, 5 moU, C), 24h |
| C2 | 1:2500 EPO RNA (A, G, 5 moU, C), 24h |
| D2 | 1:12500 EPO RNA (A, G, 5 moU, C), 24h |
| E2 | 1:62500 EPO RNA (A, G, 5 moU, C), 24h |
| F2 | 1:312500 EPO RNA (A, G, 5 moU, C), 24h |
| G2 | 1:1562500 EPO RNA (A, G, 5 moU, C), 24h |
| H2 | 1:7812500 EPO RNA (A, G, 5 moU, C), 24h |

FIG. 15

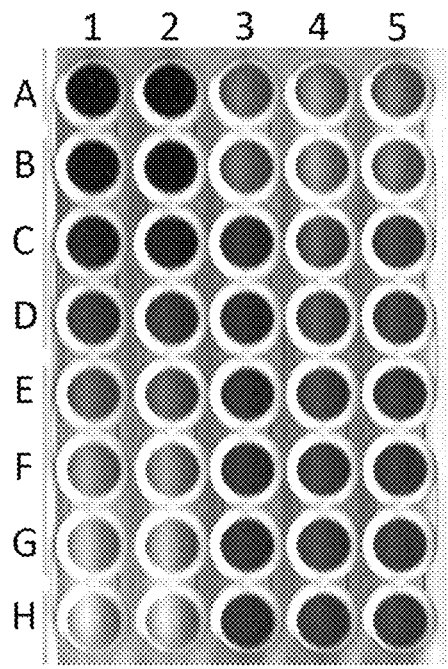

| A1, A2 | EPO Standard, 100 mU/mL |
| B1, B2 | EPO Standard, 50 mU/mL |
| C1, C2 | EPO Standard, 25 mU/mL |
| D1, D2 | EPO Standard, 12.5 mU/mL |
| E1, E2 | EPO Standard, 6.25 mU/mL |
| F1, F2 | EPO Standard, 3.12 mU/mL |
| G1, G2 | EPO Standard, 1.56 mU/mL |
| H1, H2 | EPO Standard, 0 mU/mL |
| A3, B3 | 1:2500 EPO RNA (A, G, U, C), 12h |
| C3, D3 | 1:2500 EPO RNA (A, G, U, C), 24h |
| E3, F3 | 1:2500 EPO RNA (A, G, U, C), 36h |
| G3, H3 | 1:2500 EPO RNA (A, G, U, C), 48h |
| A4, B4 | 1:2500 EPO RNA (A, G, 5 moU, C), 12h |
| C4, D4 | 1:2500 EPO RNA (A, G, 5 moU, C), 24h |
| E4, F4 | 1:2500 EPO RNA (A, G, 5 moU, C), 36h |
| G4, H4 | 1:2500 EPO RNA (A, G, 5 moU, C), 48h |
| A5, B5 | 1:2500 EPO RNA (A, G, psU, C), 12h |
| C5, D5 | 1:2500 EPO RNA (A, G, psU, C), 24h |
| E5, F5 | 1:2500 EPO RNA (A, G, psU, C), 36h |
| G5, H5 | 1:2500 EPO RNA (A, G, psU, C), 48h |

FIG. 20

| Animal # | Group | Day | Time Point | Sex | IL-6 (pg/mL) | TNFα (pg/mL) | IFNα (pg/mL) |
|---|---|---|---|---|---|---|---|
| 5 | 1 | D1 | 6H | M | ND | ND | ND |
| 6 | 1 | D1 | 6H | M | ND | ND | ND |
| 13 | 2 | D1 | 6H | M | ND | ND | ND |
| 14 | 2 | D1 | 6H | M | ND | ND | ND |
| 31 | 3 | D1 | 6H | M | ND | ND | ND |
| 32 | 3 | D1 | 6H | M | ND | ND | ND |
| 49 | 4 | D1 | 6H | M | ND | ND | ND |
| 50 | 4 | D1 | 6H | M | ND | ND | ND |
| 15 | 2 | D2 | 24H | M | ND | ND | ND |
| 16 | 2 | D2 | 24H | M | ND | ND | ND |
| 33 | 3 | D2 | 24H | M | ND | ND | ND |
| 34 | 3 | D2 | 24H | M | ND | ND | ND |
| 52 | 4 | D2 | 24H | M | ND | ND | ND |
| 63 | 4 | D2 | 24H | M | ND | ND | ND |
| 23 | 2 | D8 |  | M | ND | ND | ND |
| 24 | 2 | D8 |  | M | ND | ND | ND |
| 41 | 3 | D8 |  | M | ND | ND | 11.95 |
| 42 | 3 | D8 |  | M | ND | ND | 9.13 |
| 59 | 4 | D8 |  | M | ND | ND | 7.66 |
| 60 | 4 | D8 |  | M | ND | ND | 12.51 |

ND = Not Detectable (<10 pg/mL for TNF-alpha; < 21 pg/mL for IL-6; <4 pg/mL for IFN-alpha)

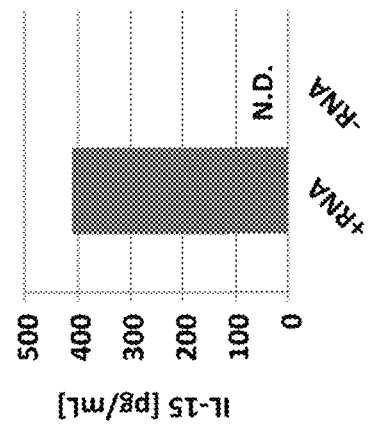
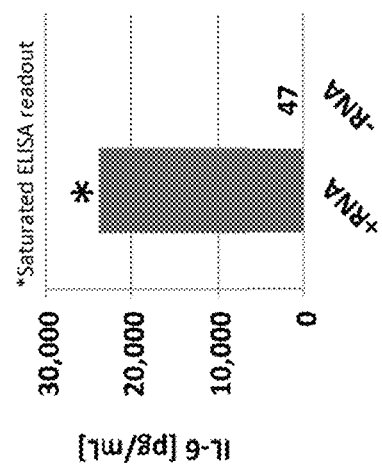
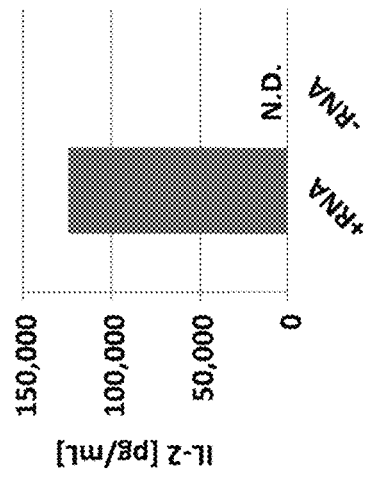
FIG. 37 (continued)

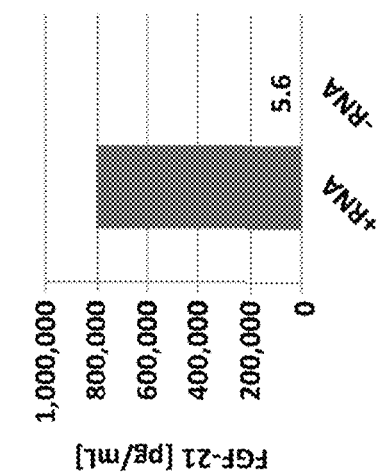
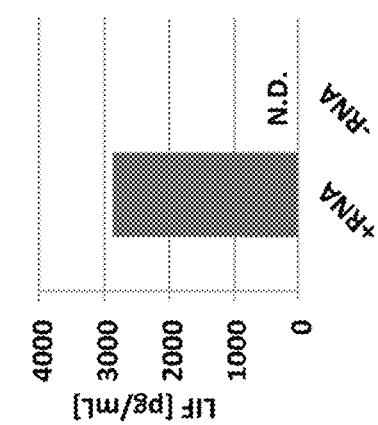
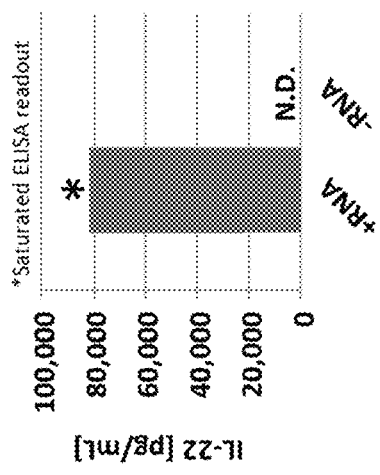
FIG. 37 (continued)

NUCLEIC ACID PRODUCTS AND METHODS OF ADMINISTRATION THEREOF

PRIORITY

This application is a national stage application under 35 U.S.C. § 371 of International Application No. PCT/US2016/018065, filed Feb. 16, 2016. PCT/US2016/018065 claims the benefit of priority of US Patent Application Nos. 62/116,232, filed Feb. 13, 2015, 62/195,462, filed Jul. 22, 2015, 62/242,383, filed Oct. 16, 2015, 62/245,726, filed Oct. 23, 2015; and 62/289,617, filed Feb. 1, 2016, the entire contents of all of which are incorporated by reference herein.

FIELD OF THE INVENTION

The present invention relates, in part, to methods, compositions, and products for producing and delivering nucleic acids to cells, tissues, organs, and patients, methods for expressing proteins in cells, tissues, organs, and patients, and cells, therapeutics, and cosmetics produced using these methods, compositions, and products.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: FAB-009PC_Sequence.txt; date recorded: Feb. 16, 2016; file size: 2.3 MB).

BACKGROUND

Synthetic RNA and Nucleic-Acid Therapeutics

Ribonucleic acid (RNA) is ubiquitous in both prokaryotic and eukaryotic cells, where it encodes genetic information in the form of messenger RNA, binds and transports amino acids in the form of transfer RNA, assembles amino acids into proteins in the form of ribosomal RNA, and performs numerous other functions including gene expression regulation in the forms of microRNA and long non-coding RNA. RNA can be produced synthetically by methods including direct chemical synthesis and in vitro transcription, and can be administered to patients for therapeutic use. However, previously described synthetic RNA molecules are unstable and trigger a potent innate-immune response in human cells. In addition, methods for efficient non-viral delivery of nucleic acids to patients, organs, tissues, and cells in vivo have not been previously described. The many drawbacks of existing synthetic RNA technologies and methods for delivery of nucleic acids make them undesirable for therapeutic or cosmetic use.

Cell Reprogramming and Cell-Based Therapies

Cells can be reprogrammed by exposing them to specific extracellular cues and/or by ectopic expression of specific proteins, microRNAs, etc. While several reprogramming methods have been previously described, most that rely on ectopic expression require the introduction of exogenous DNA, which can carry mutation risks. DNA-free reprogramming methods based on direct delivery of reprogramming proteins have been reported. However, these methods are too inefficient and unreliable for commercial use. In addition, RNA-based reprogramming methods have been described (see, e.g., Angel. MIT Thesis. 2008. 1-56; Angel et al. PLoS ONE. 2010. 5, 107; Warren et al. Cell Stem Cell. 2010. 7, 618-630; Angel. MIT Thesis. 2011. 1-89; and Lee et al. Cell. 2012. 151, 547-558; the contents of all of which are hereby incorporated by reference). However, existing RNA-based reprogramming methods are slow, unreliable, and inefficient when performed on adult cells, require many transfections (resulting in significant expense and opportunity for error), can reprogram only a limited number of cell types, can reprogram cells to only a limited number of cell types, require the use of immunosuppressants, and require the use of multiple human-derived components, including blood-derived HSA and human fibroblast feeders. The many drawbacks of previously disclosed RNA-based reprogramming methods make them undesirable for research, therapeutic or cosmetic use.

Gene Editing

Several naturally occurring proteins contain DNA-binding domains that can recognize specific DNA sequences, for example, zinc fingers (ZFs) and transcription activator-like effectors (TALEs). Fusion proteins containing one or more of these DNA-binding domains and the cleavage domain of FokI endonuclease can be used to create a double-strand break in a desired region of DNA in a cell (see, e.g., US Patent Appl. Pub. No. US 2012/0064620, US Patent Appl. Pub. No. US 2011/0239315, U.S. Pat. No. 8,470,973, US Patent Appl. Pub. No. US 2013/0217119, U.S. Pat. No. 8,420,782, US Patent Appl. Pub. No. US 2011/0301073, US Patent Appl. Pub. No. US 2011/0145940, U.S. Pat. Nos. 8,450,471, 8,440,431, 8,440,432, and US Patent Appl. Pub. No. 2013/0122581, the contents of all of which are hereby incorporated by reference). Other gene-editing proteins include clustered regularly interspaced short palindromic repeat (CRISPR)-associated proteins. However, current methods for gene editing cells are inefficient and carry a risk of uncontrolled mutagenesis, making them undesirable for research, therapeutic or cosmetic use. Methods for DNA-free gene editing of somatic cells have not been previously explored, nor have methods for simultaneous or sequential gene editing and reprogramming of somatic cells. In addition, methods for directly gene editing cells in patients (i.e., in vivo) have not been previously explored, and the development of such methods has been limited by a lack of acceptable targets, inefficient delivery, inefficient expression of the gene-editing protein/proteins, inefficient gene editing by the expressed gene-editing protein/proteins, due in part to poor binding of DNA-binding domains, excessive off-target effects, due in part to non-directed dimerization of the FokI cleavage domain and poor specificity of DNA-binding domains, and other factors. Finally, the use of gene editing in anti-bacterial, anti-viral, and anti-cancer treatments has not been previously explored.

Accordingly, there remains a need for improved methods and compositions for the production and delivery of nucleic acids to cells, tissues, organs, and patients.

SUMMARY OF THE INVENTION

The present invention provides, in part, compositions, methods, articles, and devices for delivering nucleic acids to cells, tissues, organs, and patients, methods for inducing cells to express proteins, methods, articles, and devices for producing these compositions, methods, articles, and devices, and compositions and articles, including cells, organisms, cosmetics and therapeutics, produced using these compositions, methods, articles, and devices. Unlike previously reported methods, certain embodiments of the present invention provide small doses of nucleic acids to achieve significant and lasting protein expression in humans.

In various aspects, the present invention is based on the surprising discovery of safe and effective doses and administration parameters for nucleic acid drugs in human subjects. In some aspects, there is provided a method for delivering a nucleic acid drug, comprising administering an effective dose of a nucleic acid drug to a human subject in need thereof. In various embodiments, the nucleic acid drug comprises a RNA comprising one or more non-canonical nucleotides (a/k/a "modified RNA"). In other embodiments, the effective dose is an amount sufficient to substantially increase an amount of a protein encoded by the nucleic acid drug in the human subject and/or substantially avoid an immune reaction in a human subject, wherein the immune reaction is optionally mediated by the innate immune system.

In some aspects, there is provided a method for expressing a protein of interest in a population of cells in a mammalian subject, comprising administering a non-viral transfection composition comprising an effective dose of a RNA encoding the protein of interest to said cells, where the transfection composition is administered in an amount that allows for expression of said protein in said cells for at least about six hours to about five days without substantial cellular toxicity. In some embodiments, the RNA contains one or more non-canonical nucleotides that avoid substantial cellular toxicity.

In some embodiments, the effective dose is about 100 ng to about 2000 ng (e.g., about, or no more than about, 100 ng, or 200 ng, or 300 ng, or 400 ng, or 500 ng, or 600 ng, or 700 ng, or 800 ng, or 900 ng, or 1000 ng, or 1100 ng, or 1200 ng, or 1300 ng, or 1400 ng, or 1500 ng, or 1600 ng, or 1700 ng, or 1800 ng, or 1900 ng, or 2000 ng). In other embodiments, the effective dose is less than about 100 ng. In certain embodiments, the effective dose is about 10 ng to about 100 ng (e.g., about, or no more than about, 10 ng, or 20 ng, or 30 ng, or 40 ng, or 50 ng, or 60 ng, or 70 ng, or 80 ng, or 90 ng, or 100 ng).

In some embodiments, the effective dose is about 1.4 ng/kg to about 30 ng/kg (e.g., about, or no more than about, 1.4 ng/kg, or 2.5 ng/kg, or 5 ng/kg, or 10 ng/kg, or 15 ng/kg, or 20 ng/kg, or 25 ng/kg, or 30 ng/kg. In other embodiments, the effective dose is less than about 1.5 ng/kg. In certain embodiments, the effective dose is about 0.14 ng/kg to about 1.4 ng/kg (e.g., about, or no more than about, 0.14 ng/kg, or 0.25 ng/kg, or 0.5 ng/kg, or 0.75 ng/kg, or 1 ng/kg, or 1.25 ng/kg, or 1.4 ng/kg).

In some embodiments, the effective dose is about 350 $ng/cm^2$ to about 7000 $ng/cm^2$ (e.g., about, or no more than about, 350 $ng/cm^2$, or 500 $ng/cm^2$, or 750 $ng/cm^2$, or 1000 $ng/cm^2$, or 2000 $ng/cm^2$, or 3000 $ng/cm^2$, or 4000 $ng/cm^2$, or 5000 $ng/cm^2$, or 6000 $ng/cm^2$, or 7000 $ng/cm^2$). In other embodiments, the effective dose is less than about 350 $ng/cm^2$. In certain embodiments, the effective dose is about 35 $ng/cm^2$ to about 350 $ng/cm^2$ (e.g., about, or no more than about, 35 $ng/cm^2$, or 50 $ng/cm^2$, or 75 $ng/cm^2$, or 100 $ng/cm^2$, or 150 $ng/cm^2$, or 200 $ng/cm^2$, or 250 $ng/cm^2$, or 300 $ng/cm^2$, or 350 $ng/cm^2$.

In some embodiments, the effective dose is about 0.28 picomoles to about 5.7 picomoles (e.g., about, or no more than about, 0.28 picomoles, or 0.5 picomoles, or 0.75 picomoles, or 1 picomole, or 2 picomoles, or 3 picomoles, or 4 picomoles, or 5 picomoles, or 5.7 picomoles). In other embodiments, the effective dose is less than about 0.28 picomoles. In certain embodiments, the effective dose is about 0.028 picomoles to about 0.28 picomoles (e.g., about, or no more than about, 0.028 picomoles, or 0.05 picomoles, or 0.075 picomoles, or 0.1 picomoles, or 0.15 picomoles, or 0.2 picomoles, or 0.25 picomoles, or 0.28 picomoles).

In some embodiments, the effective dose is about 0.004 picomoles/kg to about 0.082 picomoles/kg (e.g., about, or no more than about, 0.004 picomoles/kg, or 0.01 picomoles/kg, or 0.02 picomoles/kg, or 0.03 picomoles/kg, or 0.04 picomoles/kg, or 0.05 picomoles/kg, or 0.06 picomoles/kg, or 0.07 picomoles/kg, or 0.08 picomoles/kg, or 0.082 picomoles/kg). In other embodiments, the effective dose is less than about 0.004 picomoles/kg. In certain embodiments, the effective dose is about 0.0004 picomoles/kg to about 0.004 picomoles/kg (e.g., about, or no more than about, 0.0004 picomoles/kg, or 0.001 picomoles/kg, or 0.002 picomoles/kg, or 0.003 picomoles/kg, or 0.004 picomoles/kg).

In some embodiments, the effective dose is about 1 $picomole/cm^2$ to about 20 $picomoles/cm^2$ (e.g., about, or no more than about, 1 $picomole/cm^2$, or 2 $picomoles/cm^2$, or 3 $picomoles/cm^2$, or 4 $picomoles/cm^2$, or 5 $picomoles/cm^2$, or 6 $picomoles/cm^2$, or 7 $picomoles/cm^2$, or 8 $picomoles/cm^2$, or 9 $picomoles/cm^2$, or 10 $picomoles/cm^2$, or 12 $picomoles/cm^2$, or 14 $picomoles/cm^2$, or 16 $picomoles/cm^2$, or 18 $picomoles/cm^2$, or 20 $picomoles/cm^2$). In other embodiments, the effective dose is less than about 1 $picomole/cm^2$. In certain embodiments, the effective dose is about 0.1 $picomoles/cm^2$ to about 1 $picomole/cm^2$ (e.g., about, or no more than about, 0.1 $picomoles/cm^2$, or 0.2 $picomoles/cm^2$, or 0.3 $picomoles/cm^2$, or 0.4 $picomoles/cm^2$, or 0.5 $picomoles/cm^2$, or 0.6 $picomoles/cm^2$, or 0.7 $picomoles/cm^2$, or 0.8 $picomoles/cm^2$, or 0.9 $picomoles/cm^2$, or 1 $picomole/cm^2$).

In various embodiments, the nucleic acid drug is administered in a pharmaceutically acceptable formulation, including a formulation suitable for one or more of injection (e.g. subcutaneous injection, intradermal injection (including to the dermis or epidermis), subdermal injection, intramuscular injection, intraocular injection, intravitreal injection, intraarticular injection, intracardiac injection, intravenous injection, epidural injection, intrathecal injection, intratumoral injection) and topical administration and/or for administration to the integumentary system (e.g. to one or more of the epidermis (optionally selected from the stratum corneum, stratum lucidum, stratum granulosum, stratum spinosum, and stratum germinativum), basement membrane, dermis (optionally selected from the papillary region and the reticular region), subcutis, and conjunctiva) and/or for administration to the eye (e.g., to one or more of the cornea, sclera, iris, lens, corneal limbus, optic nerve, choroid, ciliary body, anterior segment, anterior chamber, and retina).

In various embodiments, the nucleic acid drug is formulated with one or more lipids to enhance uptake of the nucleic acid drug by cells, the lipids optionally selected from Table 1. In other embodiments, the nucleic acid drug is formulated with one or more nanoparticles, optionally lipid or polymeric nanoparticles, to enhance uptake of the nucleic acid drug by cells, to enhance duration of protein expression, or to otherwise enhance the safety and/or efficacy of the nucleic acid drug.

In various embodiments, the nucleic acid drug is administered locally, optionally by one or more of subcutaneous injection, intradermal injection, subdermal injection and intramuscular injection, and the effective dose is administered to a surface area of about 4 $mm^2$ to about 1000 $mm^2$ (e.g. about, or no more than about, 4 $mm^2$, or 5 $mm^2$, or 10 $mm^2$, or 25 $mm^2$, or 50 $mm^2$, or 75 $mm^2$, or 100 $mm^2$, or 125 $mm^2$, or 150 $mm^2$, or 200 $mm^2$, or 500 $mm^2$, or 1000 $mm^2$).

In various embodiments, the nucleic acid drug is administered in a treatment regimen, optionally with an additional agent or adjuvant therapy described herein, and the administration is about weekly to about once every 24 weeks (e.g. about, or not more than about, weekly, or once every 2 weeks, or once every 3 weeks, or once every 4 weeks, or once every 5 weeks, or once every 6 weeks, or once every 7 weeks, or once every 8 weeks, or once every 9 weeks, or once every 9 weeks, or once every 9 weeks, or once every 9 weeks, or once every 10 weeks, or once every 11 weeks, or once every 12 weeks, or once every 13 weeks, or once every 14 weeks, or once every 15 weeks, or once every 20 weeks, or once every 24 weeks). In other embodiments, the nucleic acid drug is administered in a treatment regimen, optionally with an additional agent or adjuvant therapy described herein, and the administration is about daily to about weekly (e.g., about, or not more than about, daily, or once every 2 days, or once every 3 days, or once every 4 days, or once every 5 days, or once every 6 days, or weekly).

In various embodiments the nucleic acid drug comprises RNA comprising one or more non-canonical nucleotides, optionally having one or more substitutions at the 2C and/or 4C and/or 5C positions for a pyrimidine or the 6C and/or 7N and/or 8C positions for a purine. In various embodiments, the non-canonical nucleotide is one or more of the non-canonical nucleotides described herein, including, for example, 5-hydroxycytidine, 5-methylcytidine, 5-hydroxymethylcytidine, 5-carboxycytidine, 5-formylcytidine, 5-methoxycytidine, pseudouridine, 5-hydroxyuridine, 5-hydroxypseudouridine, 5-methyluridine, 5-methylpseudouridine, 5-hydroxymethyluridine, 5-hydroxymethylpseudouridine, 5-carboxyuridine, 5-carboxypseudouridine, 5-formyluridine, 5-formylpseudouridine, 5-methoxyuridine, and 5-methoxypseudouridine. Further, the RNA comprising one or more non-canonical nucleotides may have one or more of a 5'-UTR comprising a Kozak consensus sequence, a 5'-UTR or 3'-UTR comprising a sequence that increases RNA stability in vivo (e.g. an alpha-globin or beta-globin 5'-UTR or an alpha-globin or beta-globin 3'-UTR), and a 3' poly(A) tail from about 20 nucleotides to about 250 nucleotides in length (e.g. about 20, or about 30, or about 40, or about 50, or about 60, or about 70, or about 80, or about 90, or about 100, or about 110, or about 120, or about 130, or about 140, or about 150, or about 160, or about 170, or about 180, or about 190, or about 200, or about 210, or about 220, or about 230, or about 240, or about 250 nucleotides in length).

Further, some aspects of the methods described herein find use in various medical treatments, including, by way of illustration, treating a disease, disorder and/or condition of the integumentary system or altering, modifying and/or changing the integumentary system (e.g. cosmetically).

Also contemplated are kits suitable for use in human therapy, comprising the nucleic acid drug described herein in a unit dosage form of about 10 ng to about 2000 ng (e.g. about, or no more than about, 10 ng, or 20 ng, or 50 ng, or 100 ng, or 200 ng, or 300 ng, or 400 ng, or 500 ng, or 600 ng, or 700 ng, or 800 ng, or 900 ng, or 1000 ng, or 1100 ng, or 1200 ng, or 1300 ng, or 1400 ng, or 1500 ng, or 1600 ng, or 1700 ng, or 1800 ng, or 1900 ng, or 2000 ng) and an injection needle.

Further, in some aspects, the present invention provides a pharmaceutical formulation comprising the nucleic acid drug described herein and one or more of the vehicles (a/k/a "transfection reagents", e.g., lipids) described herein, the formulation optionally being suitable for one or more of subcutaneous injection, intradermal injection, subdermal injection, intramuscular injection, intraocular injection, intravitreal injection, intra-articular injection, intracardiac injection, intravenous injection, epidural injection, intrathecal injection, intratumoral injection, and topical administration.

In some aspects, nucleic acid delivery patches are provided. In one aspect, devices for delivering nucleic acids using electric fields are provided. Other aspects pertain to methods and compositions for delivery of nucleic acids to the skin. Still further aspects pertain to methods and compositions for expression of proteins in the skin.

In one aspect, the invention provides methods and compositions for treating diseases and conditions in humans, including, but not limited to, prophylactic treatments, treatments for rare diseases, including, but not limited to, dermatologic rare diseases, and treatments for use in medical dermatology and aesthetic medicine. In another aspect, the invention provides cosmetics comprising nucleic acids. Still further aspects relate to methods and compositions for altering pigmentation, for example, for the treatment of pigmentation disorders. Still further aspects relate to methods and compositions for enhancing healing, including, but not limited to, healing in response to a wound or surgery. The compositions of the present invention may alter, modify and/or change the appearance of a member of the integumenary system of a subject such as, but not limited to, skin, hair and nails. Such alteration, modification and/or change may be in the context of treatment methods and/or therapeutic uses as described herein including, by way of non-limiting example, dermatological treatments and cosmetics procedures.

Further, in various embodiments, the present invention relates to the targeting of various therapeutic proteins that are not limited to dermatological applications. For example, in various embodiments, the present compositions and methods find use in methods of treatment that are mediated by the increased expression of, for example, various soluble proteins as illustrated herein. In various embodiments, the nucleic acid drug encodes and/or increases the expression of one or more of a circulating protein, an extracellular matrix protein, an engineered protein, a gene-editing protein, a protein or peptide hormone, an enzyme, erythropoietin, darbepoetin alfa, NOVEPOETIN, elastin, collagen, an antibody or antibody fragment (e.g., a neutralizing antibody or antibody fragment), an intracellular protein, telomerase reverse transcriptase, a membrane protein, a fusion protein, a receptor, a ligand binding domain, a protein inhibitor, or a biologically active fragment, analogue or variant thereof. In other embodiments, administration of the nucleic acid drug results in one or more of an increase in hematocrit, an increase in tissue elasticity, an increase in tissue strength, and increase in skin hydration and/or water retention, hair growth, fat reduction, an insertion, deletion or mutation in DNA, conversion of a prodrug to an active drug, a decrease in tumor size and/or number, a decrease in plaque size and/or number, an increase in vascularization, a decrease in vascularization, an increase in visual acuity, a decrease in pain, an increase in cardiac output (e.g., ejection fraction and stroke volume), a decrease in abnormal heart rhythm, a decrease in fibrosis, a decrease in one or more adverse neurological symptoms, conditions, or disorders (e.g., depression, dysregulation of appetite, polyphagia, anorexia, dementia, headache, fatigue, numbness, tremors, and dizziness), a decrease in erectile dysfunction, an increase in vitality, an increase in pulmonary function, an increase in kidney function, an increase in liver function, an increase in insulin sensitivity, a decrease in insulin sensitivity, a decrease in inflammation, an increase in tear production, an improvement in hearing, an increase in auditory perception, a decrease in tinnitus, a reduction in perspiration, partial or total clearance of an infection, an increase in fertility, a decrease in fertility, inhibition or neutralization of a protein, recruitment or stimulation of one or more components of the immune system, lengthening of telomeres, inhibition of cellular senescence, an increase in replicative potential, reprogramming, proliferation, differentiation, and an increase in differentiation potential.

In some aspects, RNA molecules with low toxicity and high translation efficiency are provided. In one aspect, a cell-culture medium for high-efficiency in vivo transfection, reprogramming, and gene editing of cells is provided. Other aspects pertain to methods for producing RNA molecules encoding reprogramming proteins. Still further aspects pertain to methods for producing RNA molecules encoding gene-editing proteins.

In one aspect, the invention provides high-efficiency gene-editing proteins comprising engineered nuclease cleavage domains. In another aspect, the invention provides high-fidelity gene-editing proteins comprising engineered nuclease cleavage domains. Other aspects relate to high-efficiency gene-editing proteins comprising engineered DNA-binding domains. Still further aspects pertain to high-fidelity gene-editing proteins comprising engineered DNA-binding domains. Still further aspects relate to gene-editing proteins comprising engineered repeat sequences. Some aspects relate to methods for altering the DNA sequence of a cell by transfecting the cell with or inducing the cell to express a gene-editing protein. Other aspects relate to methods for altering the DNA sequence of a cell that is present in an in vitro culture. Still further aspects relate to methods for altering the DNA sequence of a cell that is present in vivo.

In some aspects, the invention provides methods for treating cancer comprising administering to a patient a therapeutically effective amount of a gene-editing protein or a nucleic-acid encoding a gene-editing protein. In one aspect, the gene-editing protein is capable of altering the DNA sequence of a cancer associated gene. In another aspect, the cancer-associated gene is the BIRC5 gene. Still other aspects relate to therapeutics comprising nucleic acids and/or cells and methods of using therapeutics comprising nucleic acids and/or cells for the treatment of, for example, type 1 diabetes, heart disease, including ischemic and dilated cardiomyopathy, macular degeneration, Parkinson's disease, cystic fibrosis, sickle-cell anemia, thalassemia, Fanconi anemia, severe combined immunodeficiency, hereditary sensory neuropathy, xeroderma pigmentosum, Huntington's disease, muscular dystrophy, amyotrophic lateral sclerosis, Alzheimer's disease, cancer, and infectious diseases including hepatitis and HIV/AIDS. In some aspects, the nucleic acids comprise RNA. In other aspects, the RNA comprises one or more non-canonical nucleotides. In still other aspects, the nucleic acids are delivered to cells using a virus. In some aspects, the virus is a replication-competent virus. In other aspects, the virus is a replication-incompetent virus.

The details of the invention are set forth in the accompanying description below. Although methods and materials similar or equivalent to those described herein can be used in the practice or testing of the present invention, illustrative methods and materials are now described. Other features, objects, and advantages of the invention will be apparent from the description and from the claims. In the specification and the appended claims, the singular forms also include the plural unless the context clearly dictates otherwise. Unless defined otherwise, all technical and scientific terms used herein have the same meaning as commonly understood by one of ordinary skill in the art to which this invention belongs.

DETAILED DESCRIPTION OF THE FIGURES

FIG. 1 depicts primary adult human dermal fibroblasts transfected with RNA encoding green fluorescent protein ("GFP") and comprising the indicated nucleotides.

FIG. 2 depicts the result of a gene-expression analysis of the primary adult human dermal fibroblasts of FIG. 1 using a one-step real-time RT-PCR and primers designed to amplify human interferon beta mRNA. Data were normalized to the untransfected sample ("Neg."). GAPDH was used as a loading control.

FIG. 3 depicts the results of a gene-expression analysis of cells transfected with RNA comprising the indicated nucleotides, conducted as in FIG. 2. Data were normalized to the untransfected sample ("Neg."). GAPDH was used as a loading control.

FIG. 4 depicts the results of a gene-expression analysis of cells transfected with RNA comprising the indicated nucleotides, conducted as in FIG. 2, and using primers designed to amplify the indicated transcripts. Data were normalized to the untransfected sample ("Neg."). GAPDH was used as a loading control.

FIG. 5 depicts the results of a gene-expression analysis of primary human epidermal keratinocytes transfected with RNA encoding NOVEPOETIN, and comprising the indicated nucleotides, conducted as in FIG. 2. Data were normalized to the untransfected sample ("Neg."). GAPDH was used as a loading control.

FIG. 6 depicts intradermal injection of a solution comprising RNA encoding GFP into the ventral forearm of a healthy, 33 year-old, 70 kg, male human subject.

FIG. 7 depicts a region of the ventral forearm of the subject shown in FIG. 6 after treatment with RNA comprising 5-methoxyuridine and encoding GFP (injection sites 1-3) or COL7 (injection site 4). The image was taken immediately following the final injection.

FIG. 8 depicts the region of FIG. 7, 24 hours after injection.

FIG. 9 depicts the results of fluorescent imaging of the region of FIG. 7, using the indicated fluorescent channels. The dose at each injection site is also indicated. Images were taken 24 hours after injection.

FIG. 10 depicts the results of fluorescent imaging of the region of FIG. 7, using the FITC fluorescent channel. The dose at each injection site is indicated. Images were taken 48 hours after injection.

FIG. 15 depicts the results of an ELISA designed to detect darbepoetin alfa in culture media of primary human epidermal keratinocytes transfected with RNA comprising the indicated nucleotides and encoding NOVEPOETIN.

FIG. 20 depicts a table summarizing TNFα, IL-6, and IFNα cytokine levels in plasma samples collected from a maximum tolerated dose of NOVECRIT in male Sprague Dawley rats study of Example 35.

Figure 32:
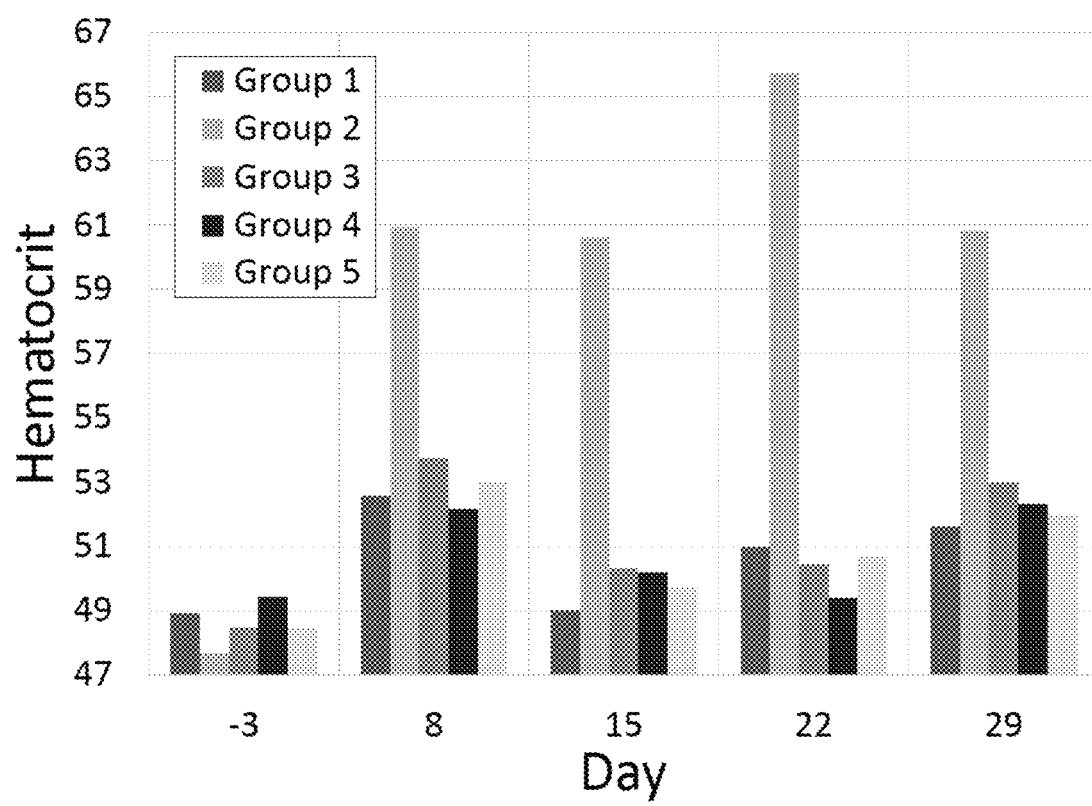

FIG. 32 demonstrates that repeated administration of NOVECRIT stimulated erythropoiesis, yielding elevated hematocrit for at least 14 days. For each data set, the order of histograms from left to right is: Group 1, Group 2, Group 3, Group 4, and Group 5.

Figure 33:
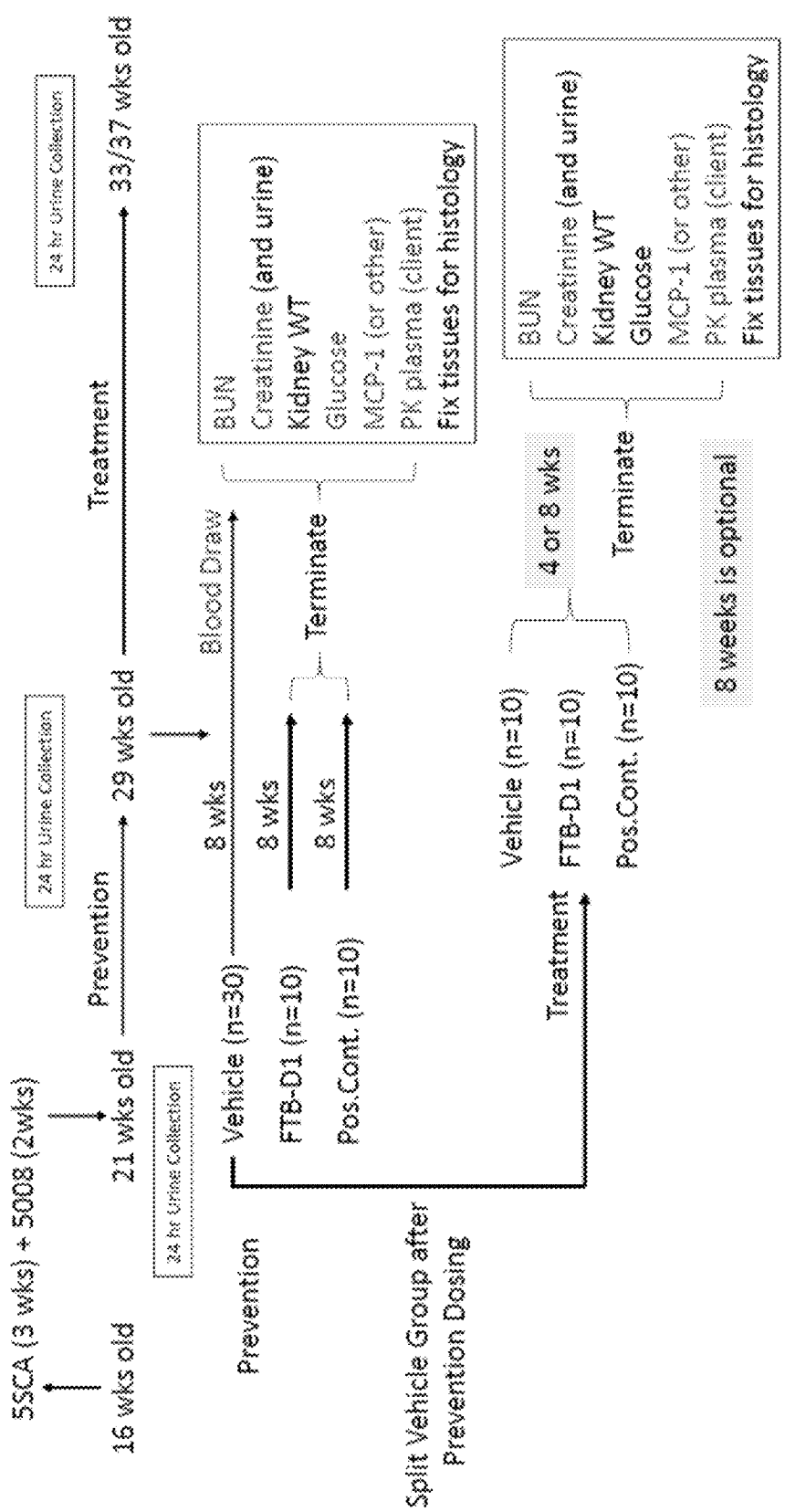

FIG. 33 provides an illustrative experimental design for studying the effects of RNAs encoding BMP7 variants for the prevention and treatment of diabetic nephropathy.

Figure 34:
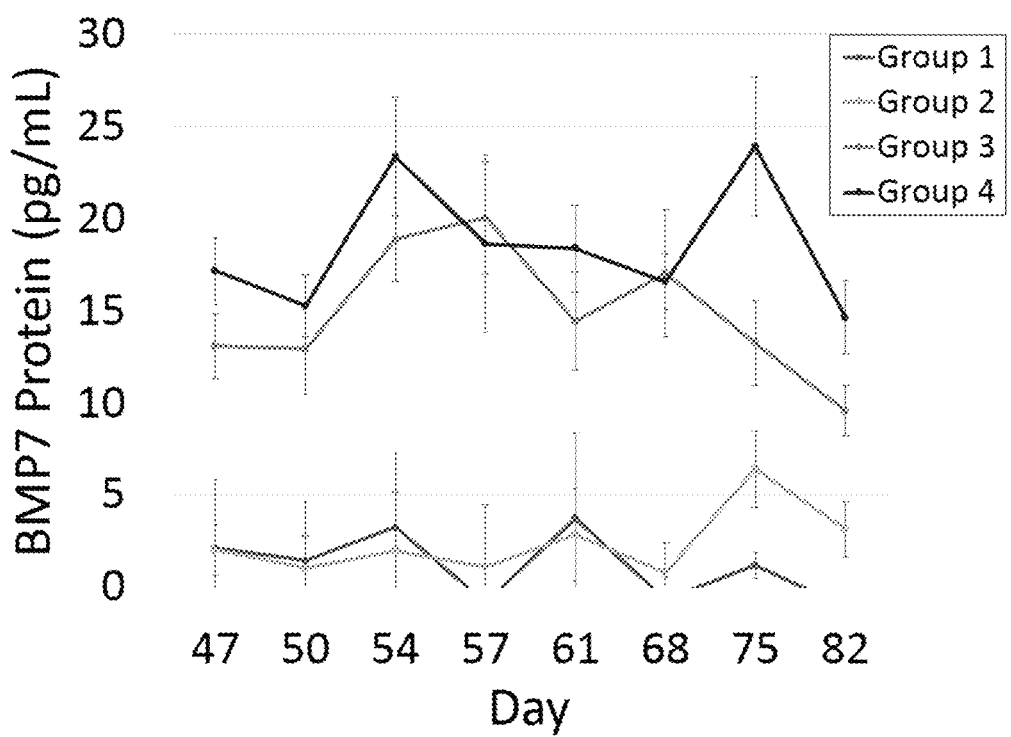

FIG. 34 depicts BMP7 protein levels in rats treated with RNAs encoding BMP7 variants as described in Example 42. Error bars indicate SEM (n=6).

Figure 35:
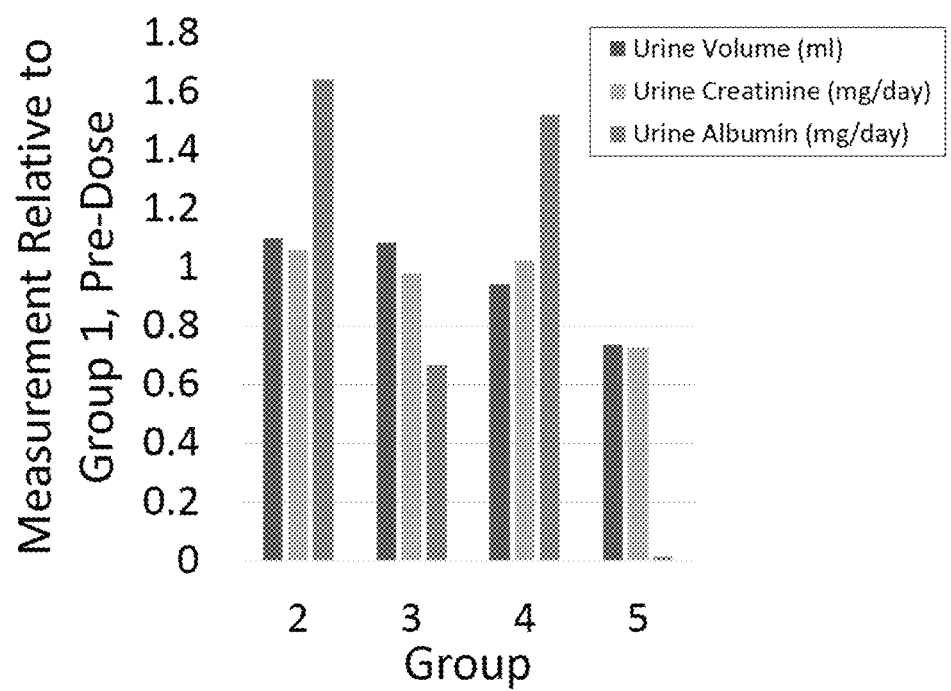

FIG. 35 depicts the urine volume, urine albumin, and urine creatinine levels in rats treated with RNAs encoding BMP7 variants as described in Example 42. For each data set, the order of histograms from left to right is: urine volume, urine creatinine, and urine albumin.

Figure 36:
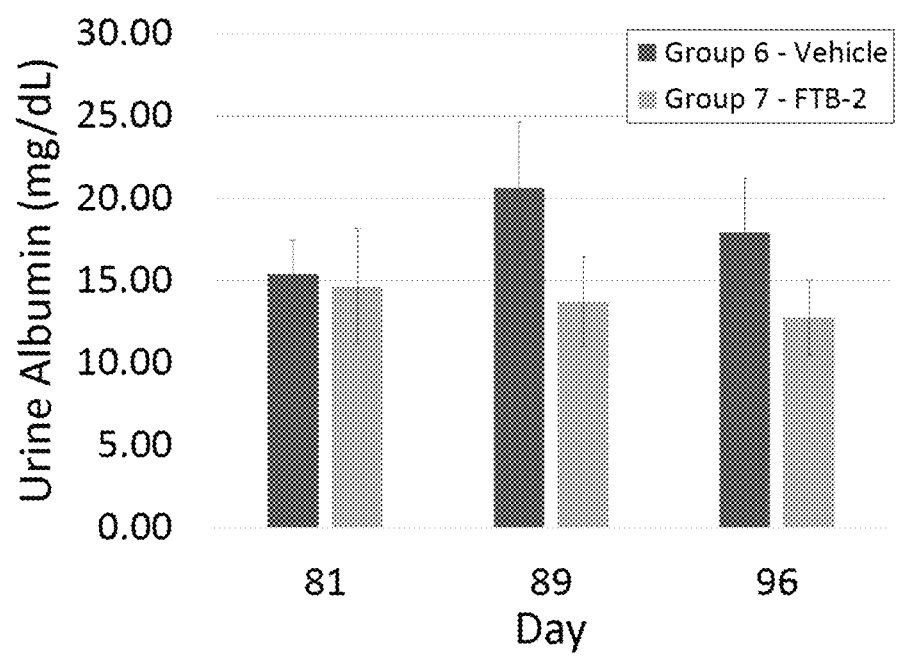

FIG. 36 depicts the effect of RNAs encoding BMP7 variants in treating diabetic nephropathy as described in Example 42. For each data set, the order of histograms from left to right is: Group 6—vehicle and Group 7—FTB-2 (BMP7 variant A).

Figure 37:
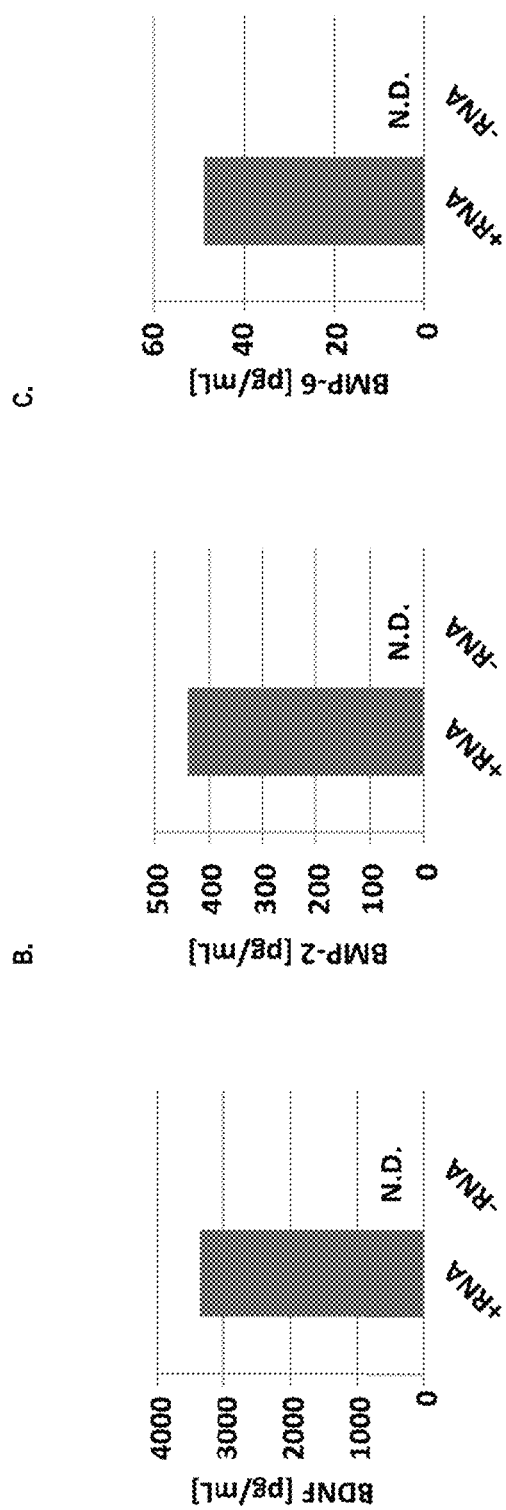

FIG. 37, panels A-I, depict the results of gene-expression analysis of human epidermal keratinocytes transfected with RNA encoding BDNF, BMP-2, BMP-6, IL-2, IL-6, IL-15, IL-22, LIF or FGF-21.

Figure 38:
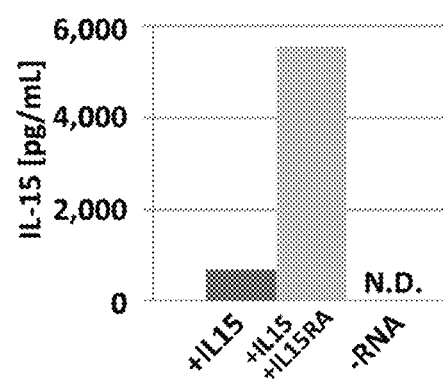

FIG. 38 depicts the results of gene-expression analysis of human epidermal keratinocytes transfected with RNA encoding IL-15 or IL-15 and IL-15RA.

Figure 39:
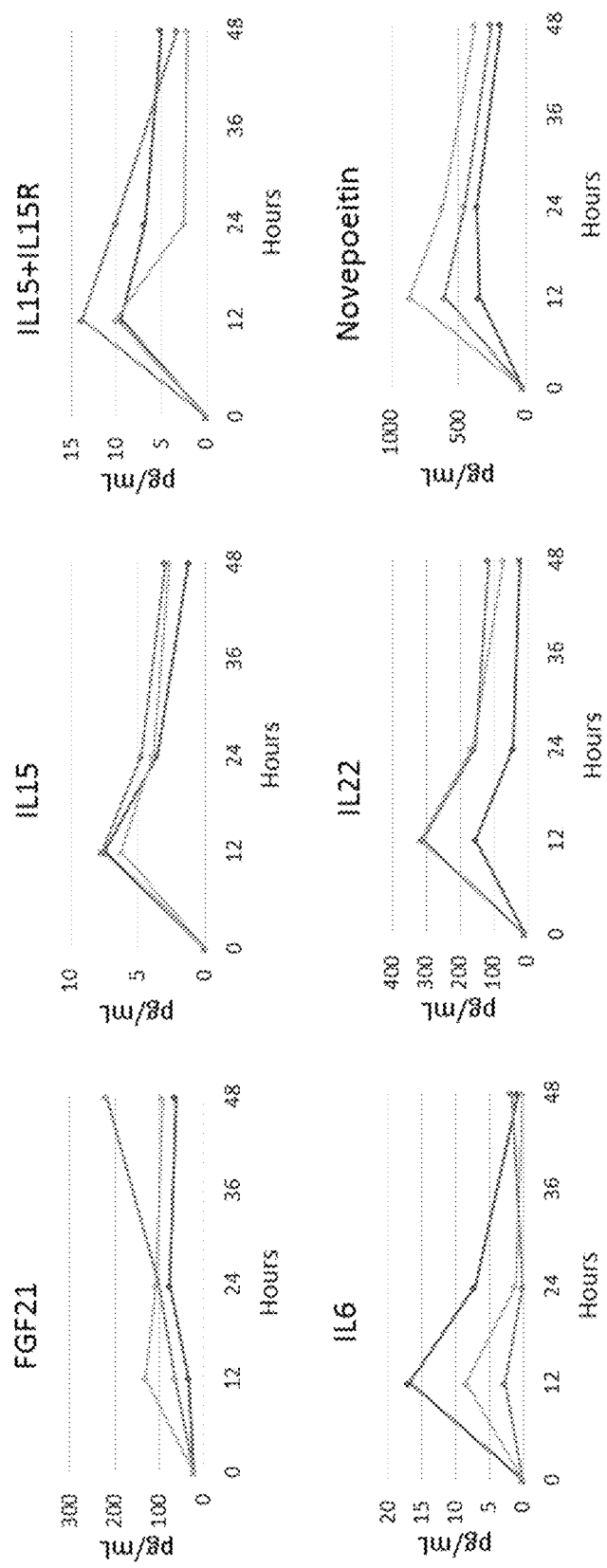

FIG. 39 depicts the serum levels of FGF21, IL15, IL6, IL22, and Novepoietin following a single intradermal injection of various RNAs encoding these proteins as described in Example 45. Three rats were analyzed for each RNA tested.

DETAILED DESCRIPTION OF THE INVENTION

The present invention is based, in part, on the discovery of a safe and effective dosing strategy for nucleic acid drugs, including RNA, such as RNA comprising non-canonical (or "modified") nucleotides, in humans. The inventors believe this to be the first report of safe and effective dosing of RNA molecules, including those comprising non-canonical nucleotides, in humans. Despite reports in the art that very large doses of RNA molecules are needed for mammalian dosing, and minimal therapeutic effect is achieved despite high dosing (see, e.g. US Patent Publication No. 2013/0245103), the present inventors have surprisingly managed to dose synthetic RNA in a human and achieve significant target protein expression with minimal immunological or other side effects.

In various embodiments, the present invention provides improved doses, formulations, administration and methods of use of nucleic acid drugs, which include RNA, which may contain non-canonical nucleotides (e.g. a residue other than adenine, guanine, thymine, uracil, and cytosine or the standard nucleoside, nucleotide, deoxynucleoside or deoxynucleotide derivatives thereof). In various embodiments, the RNA comprising non-canonical nucleotides leads to the expression of a protein encoded by the RNA, the protein often being one of therapeutic benefit (sometimes called the "target" or "protein of interest"). Further, this expression of therapeutic protein is achieved with minimal or negligible toxicity.

In various aspects, the present invention is based on the surprising discovery of safe and effective doses and administration parameters of nucleic acid drugs for human subjects. Nucleic acid drugs include a dsDNA molecule, a ssDNA molecule, a RNA molecule, a dsRNA molecule, a ssRNA molecule, a plasmid, an oligonucleotide, a synthetic RNA molecule, a miRNA molecule, an mRNA molecule, and an siRNA molecule. In various embodiments, the RNA comprises non-canonical nucleotides.

In some aspects, there is provided a method for delivering a nucleic acid drug, comprising administering an effective dose of a nucleic acid drug to a human subject in need thereof, wherein the nucleic acid drug comprises a synthetic RNA. In various embodiments, the effective dose is an amount sufficient to substantially increase an amount of a protein encoded by the nucleic acid drug in the human subject. For example, when the nucleic acid drug is a synthetic RNA comprising one or more modified nucleotides, the nucleic acid drug may result in higher protein expression than levels obtainable with a nucleic acid drug that does not comprise one or more modified nucleotides (e.g., RNA comprising the canonical nucleotides A, G, U, and C). In some embodiments, the nucleic acid drug results in about a 2-fold, or about a 3-fold, or about a 4-fold, or about a 5-fold, or about a 10-fold, or about a 15-fold, or about a 20-fold, or about a 25-fold, or about a 30-fold, or about a 35-fold, or about a 40-fold, or about a 45-fold, or about a 50-fold, or about a 100-fold increase in protein expression as compared to levels obtainable with a nucleic acid drug that does not comprise one or more modified nucleotides.

In some embodiments, the nucleic acid drug provides a sustained therapeutic effect that is optionally mediated by a sustained expression of target protein. For instance, in some embodiments, the therapeutic effect is present for over about 1 day, or over about 2 days, or over about 3 days, or over about 4 days, or over about 5 days, or over about 6 days, or over about 7 days, or over about 8 days, or over about 9 days, or over about 10 days, or over about 14 days after administration. In some embodiments, this sustained effect obviates the need for, or reduces the amount of, maintenance doses.

In some embodiments, the nucleic acid drug provides a sustained target protein level. For instance, in some embodiments, the target protein is present (e.g. in measurable amounts, e.g. in the serum of a patient to whom the nucleic acid drug has been administered) for over about 1 day, or over about 2 days, or over about 3 days, or over about 4 days, or over about 5 days, or over about 6 days, or over about 7 days, or over about 8 days, or over about 9 days, or over about 10 days, or over about 14 days after administration. In some embodiments, this sustained effect obviates the need for, or reduces the amount of, maintenance doses.

In various embodiments, the nucleic acid drug provides therapeutic action without sustained presence of the nucleic acid drug itself. In some embodiments, the nucleic acid drug is rapidly metabolized, for instance, within about 6 hours, or about 12 hours, or about 18 hours, or about 24 hours, or about 2 days, or about 3 days, or about 4 days, or about 5 days, or about 1 week from administration.

In various embodiments, the effective dose is an amount that substantially avoids cell toxicity in vivo. In various embodiments, the effective dose is an amount that substantially avoids an immune reaction in a human subject. For example, the immune reaction may be an immune response mediated by the innate immune system. Immune response can be monitored using markers known in the art (e.g. cytokines, interferons, TLRs). In some embodiments, the effective dose obviates the need for treatment of the human subject with immune suppressants agents (e.g. B18R) used to moderate the residual toxicity. Accordingly, in some embodiments, the present methods allow for dosing that provides increased protein expression and reduces toxicity.

In some embodiments, the immune response is reduced by about 10%, about 20%, about 30%, about 40%, about 50%, about 60%, about 70%, about 80%, about 90%, about 95%, about 99%, about 99.9%, or greater than about 99.9% as compared to the immune response induced by a corresponding unmodified nucleic acid. In some embodiments, upregulation of one or more immune response markers is reduced by about 10%, about 20%, about 30%, about 40%, about 50%, about 60%, about 70%, about 80%, about 90%, about 95%, about 99%, about 99.9%, or greater than about 99.9% as compared to the upregulation of the one or more immune response markers induced by a corresponding unmodified nucleic acid. In some embodiments, the immune response marker comprises an mRNA or protein product of an interferon gene, including an interferon alpha gene, IFNB1, TLR3, RARRES3, EIF2AK2, STAT1, STAT2, IFIT1, IFIT2, IFIT3, IFIT5, OAS1, OAS2, OAS3, OASL, ISG20 or a fragment, variant, analogue, or family-member thereof. In some embodiments, the immune response marker comprises an mRNA or protein product of an TNF gene, including an TNF alpha gene, TNFRSF1A; TNFRSF1B; LTBR; TNFRSF4; CD40; FAS; TNFRSF6B; CD27; TNFRSF8; TNFRSF9; TNFRSF10A; TNFRSF10B; TNFRSF10C; TNFRSF10D; TNFRSF11A; TNFRSF11B; TNFRSF12A; TNFRSF13B; TNFRSF13C; TNFRSF14; NGFR; TNFRSF17; TNFRSF18; TNFRSF19; TNFRSF21; TNFRSF25; and EDA2R or a fragment, variant, analogue, or family-member thereof. In some embodiments, the immune response marker comprises an mRNA or protein product of an interleukin gene, including an IL-6 gene, IL-1; IL-2; IL-3; IL-4; IL-5; IL-6; IL-7; IL-8 or CXCL8; IL-9; IL-10; IL-11; IL-12; IL-13; IL-14; IL-15; IL-16; IL-17; IL-18; IL-19; IL-20; IL-21; IL-22; IL-23; IL-24; IL-25; IL-26; IL-27; IL-28; IL-29; IL-30; IL-31; IL-32; IL-33; IL-35; IL-36 or a fragment, variant, analogue, or family-member thereof.

In some embodiments, cell death is about 10%, about 25%, about 50%, about 75%, about 85%, about 90%, about 95%, or over about 95% less than the cell death observed with a corresponding unmodified nucleic acid. Moreover, cell death may affect fewer than about 50%, about 40%, about 30%, about 20%, about 10%, about 5%, about 1%, about 0.1%, about 0.01% or fewer than about 0.01% of cells contacted with the modified nucleic acids.

In some embodiments, there is provided a method for expressing a protein of interest in a population of cells in a mammalian subject, comprising administering a non-viral transfection composition comprising an effective dose of a RNA encoding the protein of interest to said cells, the RNA containing one or more non-canonical nucleotides that avoid substantial cellular toxicity, where the transfection composition is administered in an amount that allows for expression of said protein in said cells for at least about five days (e.g. about 5, or about 6, or about 7, about 8, or about 9, or about 10, or about 14 days) without substantial cellular toxicity. In some embodiments, there is provided a method for expressing a protein of interest in a population of cells in a mammalian subject, comprising administering a non-viral transfection composition comprising an effective dose of a RNA encoding the protein of interest to said cells, the RNA containing one or more non-canonical nucleotides that avoid substantial cellular toxicity, where the transfection composition is administered in an amount that allows for expression of said protein in said cells for at least about six hours (e.g. about six hours, or about 12 hours, or about 1 day, or about 2 days, or about 3 days, or about 4 days, or about 5 days) without substantial cellular toxicity.

In some embodiments, the effective dose of the nucleic acid drug, including synthetic RNA, is about 100 ng to about 2000 ng, or about 200 ng to about 1900 ng, or about 300 ng to about 1800 ng, or about 400 ng to about 1700 ng, or about 500 ng to about 1600 ng, or about 600 ng to about 1500 ng, or about 700 ng to about 1400 ng, or about 800 ng to about 1300 ng, or about 900 ng to about 1200 ng, or about 1000 ng to about 1100 ng, or about 500 ng to about 2000 ng, or about 500 ng to about 1500 ng, or about 500 ng to about 1000 ng, or about 1000 ng to about 1500 ng, or about 1000 ng to about 2000 ng, or about 1500 ng to about 2000 ng, or about 100 ng to about 500 ng, or about 200 ng to about 400 ng, or about 10 ng to about 100 ng, or about 20 ng to about 90 ng, or about 30 ng to about 80 ng, or about 40 ng to about 70 ng, or about 50 ng to about 60 ng.

In some embodiments, the effective dose of the nucleic acid drug, including synthetic RNA, is no more than about 50 ng, or about 100 ng, or about 200 ng, or about 300 ng, or about 400 ng, or about 500 ng, or about 600 ng, or about 700 ng, or about 800 ng, or about 900 ng, or about 1000 ng, or about 1100 ng, or about 1200 ng, or about 1300 ng, or about 1400 ng, or about 1500 ng, or about 1600 ng, or about 1700 ng, or about 1800 ng, or about 1900 ng, or about 2000 ng.

In some embodiments, the effective dose of the nucleic acid drug, including synthetic RNA, is about 50 ng, or about 100 ng, or about 200 ng, or about 300 ng, or about 400 ng, or about 500 ng, or about 600 ng, or about 700 ng, or about 800 ng, or about 900 ng, or about 1000 ng, or about 1100 ng, or about 1200 ng, or about 1300 ng, or about 1400 ng, or about 1500 ng, or about 1600 ng, or about 1700 ng, or about 1800 ng, or about 1900 ng, or about 2000 ng.

In some embodiments, the effective dose of the nucleic acid drug, including synthetic RNA, is about 0.028 pmol, or about 0.05 pmol, or about 0.1 pmol, or about 0.2 pmol, or about 0.3 pmol, or about 0.4 pmol, or about 0.5 pmol, or about 0.6 pmol, or about 0.7 pmol, or about 0.8 pmol, or about 0.9 pmol, or about 1.0 pmol, or about 1.2 pmol, or about 1.4 pmol, or about 1.6 pmol, or about 1.8 pmol, or about 2.0 pmol, or about 2.2 pmol, or about 2.4 pmol, or about 2.6 pmol, or about 2.8 pmol, or about 3.0 pmol, or about 3.2 pmol, or about 3.4 pmol, or about 3.6 pmol, or about 3.8 pmol, or about 4.0 pmol, or about 4.2 pmol, or about 4.4 pmol, or about 4.6 pmol, or about 4.8 pmol, or about 5.0 pmol, or about 5.5 pmol, or about 5.7 pmol.

In some embodiments, the nucleic acid drug, including synthetic RNA, is administered at a concentration of about 0.1 nM, or about 0.25 nM, or about 0.5 nM, or about 0.75 nM, or about 1 nM, or about 2.5 nM, or about 5 nM, or about 7.5 nM, or about 10 nM, or about 20 nM, or about 30 nM, or about 40 nM, or about 50 nM, or about 60 nM, or about 70 nM, or about 80 nM, or about 90 nM, or about 100 nM, or about 110 nM, or about 120 nM, or about 150 nM, or about 175 nM, or about 200 nM.

In some embodiments, the effective dose of the nucleic acid drug is about 350 ng/cm$^2$, or about 500 ng/cm$^2$, or about 750 ng/cm$^2$, or about 1000 ng/cm$^2$, or about 2000 ng/cm$^2$, or about 3000 ng/cm$^2$, or about 4000 ng/cm$^2$, or about 5000 ng/cm$^2$, or about 6000 ng/cm$^2$, or about 7000 ng/cm$^2$. In other embodiments, the effective dose is less than about 350 ng/cm$^2$. In certain embodiments, the effective dose is about 35 ng/cm$^2$, or about 50 ng/cm$^2$, or about 75 ng/cm$^2$, or about 100 ng/cm$^2$, or about 150 ng/cm$^2$, or about 200 ng/cm$^2$, or about 250 ng/cm$^2$, or about 300 ng/cm$^2$, or about 350 ng/cm$^2$.

In some embodiments, the effective dose of the nucleic acid drug is about 35 ng/cm$^2$ to about 7000 ng/cm$^2$, or about 50 ng/cm$^2$ to about 5000 ng/cm$^2$, or about 100 ng/cm$^2$ to about 3000 ng/cm$^2$, or about 500 ng/cm$^2$ to about 2000 ng/cm$^2$, or about 750 ng/cm$^2$ to about 1500 ng/cm$^2$, or about 800 ng/cm$^2$ to about 1200 ng/cm$^2$, or about 900 ng/cm$^2$ to about 1100 ng/cm$^2$.

In some embodiments, the effective dose of the nucleic acid drug is about 1 picomole/cm$^2$, or about 2 picomoles/cm$^2$, or about 3 picomoles/cm$^2$, or about 4 picomoles/cm$^2$, or about 5 picomoles/cm$^2$, or about 6 picomoles/cm$^2$, or about 7 picomoles/cm$^2$, or about 8 picomoles/cm$^2$, or about 9 picomoles/cm$^2$, or about 10 picomoles/cm$^2$, or about 12 picomoles/cm$^2$, or about 14 picomoles/cm$^2$, or about 16 picomoles/cm$^2$, or about 18 picomoles/cm$^2$, or about 20 picomoles/cm$^2$. In other embodiments, the effective dose is less than about 1 picomole/cm$^2$. In certain embodiments, the effective dose is about 0.1 picomoles/cm$^2$, or about 0.2 picomoles/cm$^2$, or about 0.3 picomoles/cm$^2$, or about 0.4 picomoles/cm$^2$, or about 0.5 picomoles/cm$^2$, or about 0.6 picomoles/cm$^2$, or about 0.7 picomoles/cm$^2$, or about 0.8 picomoles/cm$^2$, or about 0.9 picomoles/cm$^2$, or about 1 picomole/cm$^2$.

In some embodiments, the effective dose of the nucleic acid drug is about 0.1 picomoles/cm$^2$ to about 20 picomoles/cm$^2$, or about 0.2 picomoles/cm$^2$ to about 15 picomoles/cm$^2$, or about 0.5 picomoles/cm$^2$ to about 10 picomoles/cm$^2$, or about 0.8 picomoles/cm$^2$ to about 8 picomoles/cm$^2$, or about 1 picomole/cm$^2$ to about 5 picomoles/cm$^2$, or about 2 picomoles/cm$^2$ to about 4 picomoles/cm$^2$.

In various embodiments, the nucleic acid drug, including synthetic RNA, is administered in a pharmaceutically acceptable formulation. In various embodiments, the nucleic acid drug, including synthetic RNA, is formulated for one or more of injection and topical administration. By way of example, the nucleic acid drug, including synthetic RNA, may be formulated for injection to a tissue of interest, e.g. a disease site (by way of non-limiting example, a tumor). In various embodiments, injection includes delivery via a patch. In some embodiments, the delivery is mediated by electrical stimulation. In various embodiments, the nucleic acid drug, including synthetic RNA, is formulated for administration to one or more of the epidermis (optionally selected from the stratum corneum, stratum lucidum, stratum granulosum, stratum spinosum, and stratum germinativum), basement membrane, dermis (optionally selected from the papillary region and the reticular region), subcutis, conjunctiva cornea, sclera, iris, lens, corneal limbus, optic nerve, choroid, ciliary body, anterior segment, anterior chamber, and retina. In various embodiments, the nucleic acid drug, including synthetic RNA, is formulated for one or more of subcutaneous injection, intradermal injection, subdermal injection, intramuscular injection, intraocular injection, intravitreal injection, intra-articular injection, intracardiac injection, intravenous injection, epidural injection, intrathecal injection, intratumoral injection, and topical administration. In various embodiments, the nucleic acid drug, including synthetic RNA, is formulated for intradermal (ID) injection to one or more of the dermis or epidermis. In various embodiments, the nucleic acid drug, including synthetic RNA, is administered in a manner such that it effects one or more of keratinocytes and fibroblasts (e.g. causes these cells to express one or more therapeutic proteins).

Accordingly, the present invention provides various formulations as described herein. Further, in some embodiments, the formulations described herein find use in the various delivery and/or treatment methods of the present invention. For instance, formulations can comprise a vesicle, for instance, a liposome (see Langer, 1990, *Science* 249: 1527-1533; Treat et al., in *Liposomes in the Therapy of Infectious Disease and Cancer*, Lopez-Berestein and Fidler (eds.), Liss, New York, pp. 353-365 (1989). In various embodiments, the formulation comprises an aqueous suspension of liposomes. Illustrative liposome components are set forth in Table 1, and are given by way of example, and not by way of limitation. In various embodiments, one or more, or two or more, or three or more, or four or more, or five or more of the lipids of Table 1 are combined in a formulation.

TABLE 1

Illustrative Biocompatible Lipids 1  3β-[N-(N',N'-dimethylaminoethane)-carbamoyl]cholesterol (DC-Cholesterol)
2  1,2-dioleoyl-3-trimethylammonium-propane (DOTAP/18:1 TAP)
3  N-(4-carboxybenzyl)-N,N-dimethyl-2,3-bis(oleoyloxy)propan-1-aminium (DOBAQ)
4  1,2-dimyristoyl-3-trimethylammonium-propane (14:0 TAP)
5  1,2-dipalmitoyl-3-trimethylammonium-propane (16:0 TAP)
6  1,2-stearoyl-3-trimethylammonium-propane (18:0 TAP)
7  1,2-dioleoyl-3-dimethylammonium-propane (DODAP/18:1 DAP)
8  1,2-dimyristoyl-3-dimethylammonium-propane (14:0 DAP)
9  1,2-dipalmitoyl-3-dimethylammonium-propane (16:0 DAP)
10 1,2-distearoyl-3-dimethylammonium-propane (18:0 DAP)
11 dimethyldioctadecylammonium (18:0 DDAB)
12 1,2-dilauroyl-sn-glycero-3-ethylphosphocholine (12:0 EthylPC)
13 1,2-dimyristoyl-sn-glycero-3-ethylphosphocholine (14:0 EthylPC)
14 1,2-dimyristoleoyl-sn-glycero-3-ethylphosphocholine (14:1 EthylPC)
15 1,2-dipalmitoyl-sn-glycero-3-ethylphosphocholine (16:0 EthylPC)
16 1,2-distearoyl-sn-glycero-3-ethylphosphocholine (18:0 EthylPC)
17 1,2-dioleoyl-sn-glycero-3-ethylphosphocholine (18:1 EthylPC)
18 1-palmitoyl-2-oleoyl-sn-glycero-3-ethylphosphocholine (16:1-18:1 EthylPC)
19 1,2-di-O-octadecenyl-3-trimethylammonium propane (DOTMA)
20 N1-[2-((1S)-1-[(3-aminopropyl)amino]-4-[di(3-aminopropyl)amino]butylcarboxamido)ethyl]-3,4-di[oleyloxy]-benzamide (MVL5)
21 2,3-dioleyloxy-N-[2-spermine carboxamide]ethyl-N,N-dimethyl-1-propanammonium trifluoroacetate (DOSPA)
22 1,3-di-oleoyloxy-2-(6-carboxy-spermyl)-propylamid (DOSPER)
23 N-[1-(2,3-dimyristyloxy)propyl]-N,N-dimethyl-N-(2-hydroxyethyl)ammonium bromide (DMRIE)

TABLE 1-continued

Illustrative Biocompatible Lipids

24 LIPOFECTAMINE, LIPOFECTAMINE 2000, LIPOFECTAMINE RNAiMAX, LIPOFECTAMINE 3000, LIPOFECTAMINE MessengerMAX, TransIT mRNA
25 dioctadecyl amidoglyceryl spermine (DOGS)
26 dioleoyl phosphatidyl ethanolamine (DOPE)

In some embodiments, the liposomes include LIPOFECTAMINE 3000. In some embodiments, the liposomes include one or more lipids described in U.S. Pat. No. 4,897,355 or 7,479,573 or in International Patent Publication No. WO/2015/089487, or in Feigner, P. L. et al. (1987) Proc. Natl. Acad. Sci. USA 84:7413-7417, the entire contents of each is incorporated by reference in their entireties).

In some embodiments, the liposome comprises N-[1-(2,3-dioleoyloxy)propyl]-N,N,N-trimethylammonium chloride (DOTMA). In some embodiments, the liposome comprises dioleoylphosphatidylethanolamine (DOPE).

In one embodiment, the liposomes include one or more polyethylene glycol (PEG) chains, optionally selected from PEG200, PEG300, PEG400, PEG600, PEG800, PEG1000, PEG1500, PEG2000, PEG3000, and PEG4000. In some embodiments, the PEG is PEG2000. In some embodiments, the liposomes include 1,2-distearoyl-sn-glycero-3-phosphoethanolamine (DSPE) or a derivative thereof.

In some embodiments, the formulation comprises one or more of N-(carbonyl-ethoxypolyethylene glycol 2000)-1,2-distearoyl-sn-glycero-3-phosphoethanolamine (MPEG2000-DSPE), fully hydrogenated phosphatidylcholine, cholesterol, LIPOFECTAMINE 3000, a cationic lipid, a polycationic lipid, and 1,2-distearoyl-sn-glycero-3-phosphoethanolamine-N-[folate(polyethylene glycol)-5000] (FA-MPEG5000-DSPE).

In one embodiment, the formulation comprises about 3.2 mg/mL N-(carbonyl-ethoxypolyethylene glycol 2000)-1,2-distearoyl-sn-glycero-3-phosphoethanolamine (MPEG2000-DSPE), about 9.6 mg/mL fully hydrogenated phosphatidylcholine, about 3.2 mg/mL cholesterol, about 2 mg/mL ammonium sulfate, and histidine as a buffer, with about 0.27 mg/mL 1,2-distearoyl-sn-glycero-3-phosphoethanolamine-N-[folate(polyethylene glycol)-5000] (FA-MPEG5000-DSPE) added to the lipid mixture. In another embodiment, the nucleic acids are complexed by combining 1 µL of LIPOFECTAMINE 3000 per about 1 µg of nucleic acid and incubating at room temperature for at least about 5 minutes. In one embodiment, the LIPOFECTAMINE 3000 is a solution comprising a lipid at a concentration of about 1 mg/mL. In some embodiments, nucleic acids are encapsulated by combining about 10 µg of the liposome formulation per about 1 µg of nucleic acid and incubating at room temperature for about 5 minutes.

In some embodiments, the formulation comprises one or more nanoparticles. In one embodiment, the nanoparticle is a polymeric nanoparticle. In various embodiments, the formulation comprises one or more of a diblock copolymer, a triblock copolymer, a tetrablock copolymer, and a multiblock copolymer. In various embodiments, the formulation comprises one or more of polymeric nanoparticles comprising a polyethylene glycol (PEG)-modified polylactic acid (PLA) diblock copolymer (PLA-PEG) and PEG-polypropylene glycol-PEG-modified PLA-tetrablock copolymer (PLA-PEG-PPG-PEG).

In some embodiments, the formulation comprises one or more lipids that are described in WO/2000/027795, the entire contents of which are hereby incorporated by reference.

In one embodiment, the therapeutic comprises one or more ligands. In another embodiment, the therapeutic comprises at least one of: androgen, CD30 (TNFRSF8), a cell-penetrating peptide, CXCR, estrogen, epidermal growth factor, EGFR, HER2, folate, insulin, insulin-like growth factor-I, interleukin-13, integrin, progesterone, stromal-derived-factor-1, thrombin, vitamin D, and transferrin or a biologically active fragment or variant thereof.

The active compositions of the present invention may include classic pharmaceutical preparations. Administration of these compositions according to the present invention may be via any common route so long as the target tissue is available via that route. This includes oral, nasal, or buccal. Alternatively, administration may be by intradermal, subcutaneous, intramuscular, intraperitoneal or intravenous injection, or by direct injection into diseased, e.g. cancer, tissue. The agents disclosed herein may also be administered by catheter systems. Such compositions would normally be administered as pharmaceutically acceptable compositions as described herein.

Administration of the compositions described herein may be, for example, by injection, topical administration, ophthalmic administration and intranasal administration. The injection, in some embodiments, may be linked to an electrical force (e.g. electroporation, including with devices that find use in electrochemotherapy (e.g. CLINIPORATOR, IGEA Srl, Carpi [MO], Italy)). The topical administration may be, but is not limited to, a cream, lotion, ointment, gel, spray, solution and the like. The topical administration may further include a penetration enhancer such as, but not limited to, surfactants, fatty acids, bile salts, chelating agents, non-chelating non-surfactants, polyoxyethylene-9-lauryl ether, polyoxyethylene-20-cetyl ether, fatty acids and/or salts in combination with bile acids and/or salts, sodium salt in combination with lauric acid, capric acid and UDCA, and the like. The topical administration may also include a fragrance, a colorant, a sunscreen, an antibacterial and/or a moisturizer. The compositions described herein may be administered to at least one site such as, but not limited to, forehead, scalp, hair follicles, hair, upper eyelids, lower eyelids, eyebrows, eyelashes, infraorbital area, periorbital areas, temple, nose, nose bridge, cheeks, tongue, nasolabial folds, lips, periobicular areas, jaw line, ears, neck, breast, forearm, upper arm, palm, hand, finger, nails, back, abdomen, sides, buttocks, thigh, calf, feet, toes and the like.

Routes of administration include, for example: intradermal, intramuscular, intraperitoneal, intravenous, subcutaneous, intranasal, epidural, oral, sublingual, intranasal, intracerebral, intravaginal, transdermal, rectally, by inhalation, or topically, particularly to the ears, nose, eyes, or skin. In some embodiments, the administering is effected orally or by parenteral injection.

Upon formulation, solutions may be administered in a manner compatible with the dosage formulation and in such amount as is therapeutically effective, as described herein. The formulations may easily be administered in a variety of dosage forms such as injectable solutions, drug release capsules and the like. For parenteral administration in an aqueous solution, for example, the solution generally is suitably buffered and the liquid diluent first rendered isotonic with, for example, sufficient saline or glucose. Such aqueous solutions may be used, for example, for intravenous, intramuscular, subcutaneous and intraperitoneal administration. Preferably, sterile aqueous media are employed as is known to those of skill in the art, particularly in light of the present disclosure.

In various embodiments, the nucleic acid drug, including RNA comprising one or more non-canonical nucleotides, and/or formulations comprising the same, is administered locally, optionally by one or more of subcutaneous injection, intradermal injection, subdermal injection and intramuscular injection, and the effective dose is administered to a surface area of about 4 mm$^2$ to about 150 mm$^2$ (e.g. about, or no more than about, 4 mm$^2$, or about 5 mm$^2$, or about 6 mm$^2$, or about 7 mm$^2$, or about 8 mm$^2$, or about 10 mm$^2$, or about 20 mm$^2$, or about 50 mm$^2$, or about 100 mm$^2$, or about 150 mm$^2$). In various embodiments, the nucleic acid drug, including RNA comprising one or more non-canonical nucleotides, and/or formulations comprising the same, is administered locally, optionally by one or more of subcutaneous injection, intradermal injection, subdermal injection and intramuscular injection, and the effective dose administered to a surface area of no more than about 4 mm$^2$, or about 5 mm$^2$, or about 6 mm$^2$, or about 7 mm$^2$, or about 8 mm$^2$, or about 10 mm$^2$, or about 20 mm$^2$, or about 50 mm$^2$, or about 100 mm$^2$, or about 150 mm$^2$. In various embodiments, the nucleic acid drug, including RNA comprising one or more non-canonical nucleotides, and/or formulations comprising the same, is administered locally, optionally by one or more of subcutaneous injection, intradermal injection, subdermal injection and intramuscular injection, and the effective dose administered to a surface area of about 4 mm$^2$, or about 5 mm$^2$, or about 6 mm$^2$, or about 7 mm$^2$, or about 8 mm$^2$, or about 10 mm$^2$, or about 20 mm$^2$, or about 50 mm$^2$, or about 100 mm$^2$, or about 150 mm$^2$.

In various embodiments, the nucleic acid drug, including RNA comprising one or more non-canonical nucleotides, and/or formulations comprising the same, is administered locally, optionally by one or more of subcutaneous injection, intradermal injection, subdermal injection and intramuscular injection, and the effective dose (weight RNA/surface area of injection) is about 35 ng/cm$^2$ to about 7000 ng/cm$^2$. In various embodiments, the nucleic acid drug, including RNA comprising one or more non-canonical nucleotides, and/or formulations comprising the same, is administered locally, optionally by one or more of subcutaneous injection, intradermal injection, subdermal injection and intramuscular injection, and the effective dose (weight RNA/surface area of injection) is no more than about 35 ng/cm$^2$, or about 50 ng/cm$^2$, or about 75 ng/cm$^2$, or about 100 ng/cm$^2$, or about 125 ng/cm$^2$, or about 150 ng/cm$^2$, or about 175 ng/cm$^2$, or about 200 ng/cm$^2$, or about 225 ng/cm$^2$, or about 250 ng/cm$^2$, or about 500 ng/cm$^2$, or about 1000 ng/cm$^2$, or about 2000 ng/cm$^2$, or about 5000 ng/cm$^2$, or about 7000 ng/cm$^2$. In various embodiments, the nucleic acid drug, including RNA comprising one or more non-canonical nucleotides, and/or formulations comprising the same, is administered locally, optionally by one or more of subcutaneous injection, intradermal injection, subdermal injection and intramuscular injection, and the effective dose (weight RNA/surface area of injection) is about 35 ng/cm$^2$, or about 50 ng/cm$^2$, or about 75 ng/cm$^2$, or about 100 ng/cm$^2$, or about 125 ng/cm$^2$, or about 150 ng/cm$^2$, or about 175 ng/cm$^2$, or about 200 ng/cm$^2$, or about 225 ng/cm$^2$, or about 250 ng/cm$^2$, or about 500 ng/cm$^2$, or about 1000 ng/cm$^2$, or about 2000 ng/cm$^2$, or about 5000 ng/cm$^2$, or about 7000 ng/cm$^2$.

Pharmaceutical preparations may additionally comprise delivery reagents (a.k.a. "transfection reagents", a.k.a. "vehicles", a.k.a. "delivery vehicles") and/or excipients.

Pharmaceutically acceptable delivery reagents, excipients, and methods of preparation and use thereof, including methods for preparing and administering pharmaceutical preparations to patients (a.k.a. "subjects") are well known in the art, and are set forth in numerous publications, including, for example, in US Patent Appl. Pub. No. US 2008/0213377, the entirety of which is incorporated herein by reference.

For example, the present compositions can be in the form of pharmaceutically acceptable salts. Such salts include those listed in, for example, J. Pharma. Sci. 66, 2-19 (1977) and The Handbook of Pharmaceutical Salts; Properties, Selection, and Use. P. H. Stahl and C. G. Wermuth (eds.), Verlag, Zurich (Switzerland) 2002, which are hereby incorporated by reference in their entirety. Non-limiting examples of pharmaceutically acceptable salts include: sulfate, citrate, acetate, oxalate, chloride, bromide, iodide, nitrate, bisulfate, phosphate, acid phosphate, isonicotinate, lactate, salicylate, acid citrate, tartrate, oleate, tannate, pantothenate, bitartrate, ascorbate, succinate, maleate, gentisinate, fumarate, gluconate, glucaronate, saccharate, formate, benzoate, glutamate, methanesulfonate, ethanesulfonate, benzenesulfonate, p-toluenesulfonate, camphorsulfonate, pamoate, phenylacetate, trifluoroacetate, acrylate, chlorobenzoate, dinitrobenzoate, hydroxybenzoate, methoxybenzoate, methylbenzoate, o-acetoxybenzoate, naphthalene-2-benzoate, isobutyrate, phenylbutyrate, α-hydroxybutyrate, butyne-1,4-dicarboxylate, hexyne-1,4-dicarboxylate, caprate, caprylate, cinnamate, glycollate, heptanoate, hippurate, malate, hydroxymaleate, malonate, mandelate, mesylate, nicotinate, phthalate, teraphthalate, propiolate, propionate, phenylpropionate, sebacate, suberate, p-bromobenzenesulfonate, chlorobenzenesulfonate, ethylsulfonate, 2-hydroxyethylsulfonate, methylsulfonate, naphthalene-1-sulfonate, naphthalene-2-sulfonate, naphthalene-1,5-sulfonate, xylenesulfonate, tartarate salts, hydroxides of alkali metals such as sodium, potassium, and lithium; hydroxides of alkaline earth metal such as calcium and magnesium; hydroxides of other metals, such as aluminum and zinc; ammonia, and organic amines, such as unsubstituted or hydroxy-substituted mono-, di-, or tri-alkylamines, dicyclohexylamine; tributyl amine; pyridine; N-methyl, N-ethylamine; diethylamine; triethylamine; mono-, bis-, or tris-(2-OH-lower alkylamines), such as mono-; bis-, or tris-(2-hydroxyethyl)amine, 2-hydroxy-tert-butylamine, or tris-(hydroxymethyl)methylamine, N,N-di-lower alkyl-N-(hydroxyl-lower alkyl)-amines, such as N,N-dimethyl-N-(2-hydroxyethyl)amine or tri-(2-hydroxyethyl)amine; N-methyl-D-glucamine; and amino acids such as arginine, lysine, and the like.

The present pharmaceutical compositions can comprises excipients, including liquids such as water and oils, including those of petroleum, animal, vegetable, or synthetic origin, such as peanut oil, soybean oil, mineral oil, sesame oil and the like. The pharmaceutical excipients can be, for example, saline, gum acacia, gelatin, starch paste, talc, keratin, colloidal silica, urea and the like. In addition, auxiliary, stabilizing, thickening, lubricating, and coloring agents can be used. In one embodiment, the pharmaceutically acceptable excipients are sterile when administered to a subject. Suitable pharmaceutical excipients also include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Any agent described herein, if desired, can also comprise minor amounts of wetting or emulsifying agents, or pH buffering agents.

Dosage forms suitable for parenteral administration (e.g. subcutaneous, intradermal, subdermal, intramuscular, intravenous, intraperitoneal, intra-articular, and infusion) include, for example, solutions, suspensions, dispersions, emulsions, and the like. They may also be manufactured in the form of sterile solid compositions (e.g. lyophilized composition), which can be dissolved or suspended in sterile injectable medium immediately before use. They may contain, for example, suspending or dispersing agents known in the art.

In some embodiments, the formulations described herein may comprise albumin and a nucleic acid molecule.

In some embodiments, the invention relates to a cosmetic composition. In one embodiment, the cosmetic composition comprises albumin. In another embodiment, the albumin is treated with an ion-exchange resin or charcoal. In yet another embodiment, the cosmetic composition comprises a nucleic acid molecule. In a further embodiment, the cosmetic composition comprises both albumin and a nucleic acid molecule. Still other embodiments are directed to a cosmetic treatment article comprising a cosmetic composition contained in a device configured to deliver the composition to a patient. Still other embodiments are directed to a device configured to deliver a cosmetic composition to a patient. In one embodiment, the nucleic acid molecule encodes a member of the group: elastin, collagen, tyrosinase, melanocortin 1 receptor, keratin, filaggren, an antibody, and hyaluronan synthase or a biologically active fragment, variant, analogue or family member thereof.

In some embodiments, the present invention provides treatment regimens. The inventors have discovered that the doses and administration described herein can produce a substantial protein expression effect quickly (e.g. in about 6, or about 12, or about 24, or about 36, or about 48 hours). Further, these effects can be sustained for about 7 days, or longer. In some embodiments, the present methods provide for administration of a nucleic acid drug, including RNA comprising one or more non-canonical nucleotides, about weekly to about once every 20 weeks.

In some embodiments, the nucleic acid drug, including RNA comprising one or more non-canonical nucleotides, is administered about weekly, for at least 2 weeks (e.g. 3, or 4, or 5, or 6, or 7, or 8, or 9, or 10 weeks). In some embodiments, the nucleic acid drug, including RNA comprising one or more non-canonical nucleotides, is administered about every other week for at least one month (e.g. 1, or 2, or 3, or 4, or 5, or 6, or 12 months). In some embodiments, the nucleic acid drug, including RNA comprising one or more non-canonical nucleotides, is administered monthly or about every other month. In some embodiments, the nucleic acid drug, including RNA comprising one or more non-canonical nucleotides, is administered is administered for at least two months, or at least 4 months, or at least 6 months, or at least 9 months, or at least one year.

In some embodiments, the nucleic acid drug, including RNA comprising one or more non-canonical nucleotides, is administered about weekly, or about once every 2 weeks, or about once every 3 weeks, or about once every 4 weeks, or about once every 5 weeks, or about once every 6 weeks, or about once every 7 weeks, or about once every 8 weeks, or about once every 9 weeks, or about once every 10 weeks, or about once every 11 weeks, or about once every 12 weeks, or about once every 13 weeks, or about once every 14 weeks, or about once every 15 weeks, or about once every 20 weeks, or about once every 24 weeks.

In some embodiments, the nucleic acid drug, including RNA comprising one or more non-canonical nucleotides, is administered no more than about weekly, or about once every 2 weeks, or about once every 3 weeks, or about once every 4 weeks, or about once every 5 weeks, or about once every 6 weeks, or about once every 7 weeks, or about once every 8 weeks, or about once every 9 weeks, or about once every 10 weeks, or about once every 11 weeks, or about once every 12 weeks, or about once every 13 weeks, or about once every 14 weeks, or about once every 15 weeks, or about once every 20 weeks, or about 24 weeks.

Certain proteins have long half-lives, and can persist in tissues for several hours, days, weeks, months or years. It has now been discovered that certain methods of treating a patient can result in accumulation of one or more proteins, including, for example, one or more beneficial proteins. Certain embodiments are therefore directed to a method for treating a patient comprising delivering to a patient in a series of doses a nucleic acid encoding one or more proteins. In one embodiment the nucleic acid comprises RNA comprising one or more non-canonical nucleotides. In another embodiment, a first dose is given at a first time-point. In yet another embodiment, a second dose is given at a second time-point. In a further embodiment, the amount of at least one of the one or more proteins in the patient at the second time-point is greater than the amount of said protein at the first time-point. In a still further embodiment, the method results in the accumulation of said protein in the patient.

In various embodiments, the present invention relates to nucleic acid drugs, which, in various embodiments are RNA comprising one or more non-canonical nucleotides. Certain non-canonical nucleotides, when incorporated into RNA molecules, can reduce the toxicity of the RNA molecules, in part, without wishing to be bound by theory, by interfering with binding of proteins that detect exogenous nucleic acids, for example, protein kinase R, Rig-1 and the oligoadenylate synthetase family of proteins. Non-canonical nucleotides that have been reported to reduce the toxicity of RNA molecules when incorporated therein include: pseudouridine, 5-methyluridine, 2-thiouridine, 5-methylcytidine, N6-methyladenosine, and certain combinations thereof. However, the chemical characteristics of non-canonical nucleotides that can enable them to lower the in vivo toxicity of RNA molecules have, until this point, remained unknown. Furthermore, incorporation of large amounts of most non-canonical nucleotides, for example, 5-methyluridine, 2-thiouridine, 5-methylcytidine, and N6-methyladenosine, can reduce the efficiency with which RNA molecules can be translated into protein, limiting the utility of RNA molecules containing these nucleotides in applications that require protein expression. In addition, while pseudouridine can be completely substituted for uridine in RNA molecules without reducing the efficiency with which the synthetic RNA molecules can be translated into protein, in certain situations, for example, when performing frequent, repeated transfections, synthetic RNA molecules containing only adenosine, guanosine, cytidine, and pseudouridine can exhibit excessive toxicity.

It has now been discovered that, and in some embodiments the invention pertains to, RNA molecules containing one or more non-canonical nucleotides that include one or more substitutions at the 2C and/or 4C and/or 5C positions in the case of a pyrimidine or the 6C and/or 7N and/or 8C positions in the case of a purine can be less toxic than synthetic RNA molecules containing only canonical nucleotides, due in part to the ability of substitutions at these positions to interfere with recognition of synthetic RNA molecules by proteins that detect exogenous nucleic acids, and furthermore, that substitutions at these positions can have minimal impact on the efficiency with which the synthetic RNA molecules can be translated into protein, due in part to the lack of interference of substitutions at these positions with base-pairing and base-stacking interactions.

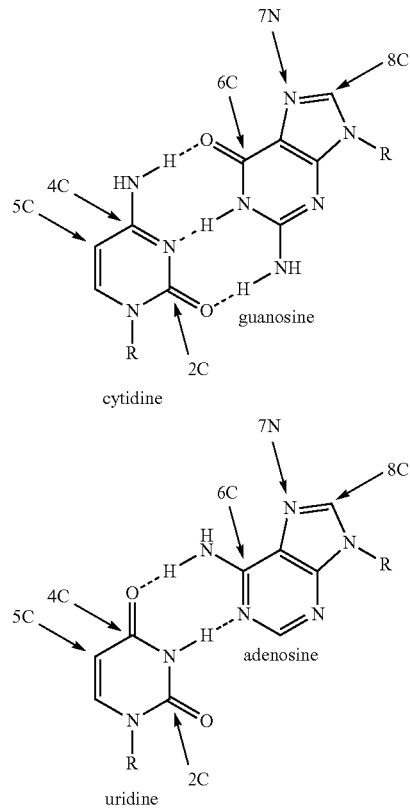

Examples of non-canonical nucleotides that include one or more substitutions at the 2C and/or 4C and/or 5C positions in the case of a pyrimidine or the 6C and/or 7N and/or 8C positions in the case of a purine include, but are not limited to: 2-thiouridine, 5-azauridine, pseudouridine, 4-thiouridine, 5-methyluridine, 5-methylpseudouridine, 5-aminouridine, 5-aminopseudouridine, 5-hydroxyuridine, 5-hydroxypseudouridine, 5-methoxyuridine, 5-methoxypseudouridine, 5-hydroxymethyluridine, 5-hydroxymethylpseudouridine, 5-carboxyuridine, 5-carboxypseudouridine, 5-formyluridine, 5-formylpseudouridine, 5-methyl-5-azauridine, 5-amino-5-azauridine, 5-hydroxy-5-azauridine, 5-methylpseudouridine, 5-aminopseudouridine, 5-hydroxypseudouridine, 4-thio-5-azauridine, 4-thiopseudouridine, 4-thio-5-methyluridine, 4-thio-5-aminouridine, 4-thio-5-hydroxyuridine, 4-thio-5-methyl-5-azauridine, 4-thio-5-amino-5-azauridine, 4-thio-5-hydroxy-5-azauridine, 4-thio-5-methylpseudouridine, 4-thio-5-aminopseudouridine, 4-thio-5-hydroxypseudouridine, 2-thiocytidine, 5-azacytidine, pseudoisocytidine, N4-methylcytidine, N4-aminocytidine, N4-hydroxycytidine, 5-methylcytidine, 5-aminocytidine, 5-hydroxycytidine, 5-methoxycytidine, 5-hydroxymethylcytidine, 5-carboxycytidine, 5-formylcytidine, 5-methyl-5-azacytidine, 5-amino-5-azacytidine, 5-hydroxy-5-azacytidine, 5-methylpseudoisocytidine, 5-aminopseudoisocytidine, 5-hydroxypseudoisocytidine, N4-methyl-5-azacytidine, N4-methylpseudoisocytidine, 2-thio-5-azacytidine, 2-thiopseudoisocytidine, 2-thio-N4-methylcytidine, 2-thio-N4-aminocytidine, 2-thio-N4-hydroxycytidine, 2-thio-5-methylcytidine, 2-thio-5-aminocytidine, 2-thio-5-hydroxycytidine, 2-thio-5-methyl- 5-azacytidine, 2-thio-5-amino-5-azacytidine, 2-thio-5-hydroxy-5-azacytidine, 2-thio-5-methylpseudoisocytidine, 2-thio-5-aminopseudoisocytidine, 2-thio-5-hydroxypseudoisocytidine, 2-thio-N4-methyl-5-azacytidine, 2-thio-N4-methylpseudoisocytidine, N4-methyl-5-methylcytidine, N4-methyl-5-aminocytidine, N4-methyl-5-hydroxycytidine, N4-methyl-5-methyl-5-azacytidine, N4-methyl-5-amino-5-azacytidine, N4-methyl-5-hydroxy-5-azacytidine, N4-methyl-5-methylpseudoisocytidine, N4-methyl-5-aminopseudoisocytidine, N4-methyl-5-hydroxypseudoisocytidine, N4-amino-5-azacytidine, N4-aminopseudoisocytidine, N4-amino-5-methylcytidine, N4-amino-5-aminocytidine, N4-amino-5-hydroxycytidine, N4-amino-5-methyl-5-azacytidine, N4-amino-5-amino-5-azacytidine, N4-amino-5-hydroxy-5-azacytidine, N4-amino-5-methylpseudoisocytidine, N4-amino-5-aminopseudoisocytidine, N4-amino-5-hydroxypseudoisocytidine, N4-hydroxy-5-azacytidine, N4-hydroxypseudoisocytidine, N4-hydroxy-5-methylcytidine, N4-hydroxy-5-aminocytidine, N4-hydroxy-5-hydroxycytidine, N4-hydroxy-5-methyl-5-azacytidine, N4-hydroxy-5-amino-5-azacytidine, N4-hydroxy-5-hydroxy-5-azacytidine, N4-hydroxy-5-methylpseudoisocytidine, N4-hydroxy-5-aminopseudoisocytidine, N4-hydroxy-5-hydroxypseudoisocytidine, 2-thio-N4-methyl-5-methylcytidine, 2-thio-N4-methyl-5-aminocytidine, 2-thio-N4-methyl-5-hydroxycytidine, 2-thio-N4-methyl-5-methyl-5-azacytidine, 2-thio-N4-methyl-5-amino-5-azacytidine, 2-thio-N4-methyl-5-hydroxy-5-azacytidine, 2-thio-N4-methyl-5-methylpseudoisocytidine, 2-thio-N4-methyl-5-aminopseudoisocytidine, 2-thio-N4-methyl-5-hydroxypseudoisocytidine, 2-thio-N4-amino-5-azacytidine, 2-thio-N4-aminopseudoisocytidine, 2-thio-N4-amino-5-methylcytidine, 2-thio-N4-amino-5-aminocytidine, 2-thio-N4-amino-5-hydroxycytidine, 2-thio-N4-amino-5-methyl-5-azacytidine, 2-thio-N4-amino-5-amino-5-azacytidine, 2-thio-N4-amino-5-hydroxy-5-azacytidine, 2-thio-N4-amino-5-methylpseudoisocytidine, 2-thio-N4-amino-5-aminopseudoisocytidine, 2-thio-N4-amino-5-hydroxypseudoisocytidine, 2-thio-N4-hydroxy-5-azacytidine, 2-thio-N4-hydroxypseudoisocytidine, 2-thio-N4-hydroxy-5-methylcytidine, N4-hydroxy-5-aminocytidine, 2-thio-N4-hydroxy-5-hydroxycytidine, 2-thio-N4-hydroxy-5-methyl-5-azacytidine, 2-thio-N4-hydroxy-5-amino-5-azacytidine, 2-thio-N4-hydroxy-5-hydroxy-5-azacytidine, 2-thio-N4-hydroxy-5-methylpseudoisocytidine, 2-thio-N4-hydroxy-5-aminopseudoisocytidine, 2-thio-N4-hydroxy-5-hydroxypseudoisocytidine, N6-methyladenosine, N6-aminoadenosine, N6-hydroxyadenosine, 7-deazaadenosine, 8-azaadenosine, N6-methyl-7-deazaadenosine, N6-methyl-8-azaadenosine, 7-deaza-8-azaadenosine, N6-methyl-7-deaza-8-azaadenosine, N6-amino-7-deazaadenosine, N6-amino-8-azaadenosine, N6-amino-7-deaza-8-azaadenosine, N6-hydroxyadenosine, N6-hydroxy-7-deazaadenosine, N6-hydroxy-8-azaadenosine, N6-hydroxy-7-deaza-8-azaadenosine, 6-thioguanosine, 7-deazaguanosine, 8-azaguanosine, 6-thio-7-deazaguanosine, 6-thio-8-azaguanosine, 7-deaza-8-azaguanosine, 6-thio-7-deaza-8-azaguanosine, and 5-methoxyuridine.

In some embodiments, the invention relates to one or more non-canonical nucleotides selected from 5-hydroxycytidine, 5-methylcytidine, 5-hydroxymethylcytidine, 5-carboxycytidine, 5-formylcytidine, 5-methoxycytidine, 5-hydroxyuridine, 5-hydroxymethyluridine, 5-carboxyuridine, 5-formyluridine, 5-methoxyuridine, pseudouridine, 5-hydroxypseudouridine, 5-methylpseudouridine, 5-hydroxymethylpseudouridine, 5-carboxypseudouridine, 5-formylpseudouridine, and 5-methoxypseudouridine. In some embodiments, at least 50%, or at least 55%, or at least 60%, or at least 65%, or at least 70%, or at least 75%, or at least 80%, or at least 85%, or at least 90%, or at least 95%, or 100% of the non-canonical nucleotides are one or more of 5-hydroxycytidine, 5-methylcytidine, 5-hydroxymethylcytidine, 5-carboxycytidine, 5-formylcytidine, 5-methoxycytidine, 5-hydroxyuridine, 5-methyluridine, 5-hydroxymethyluridine, 5-carboxyuridine, 5-formyluridine, 5-methoxyuridine, pseudouridine, 5-hydroxypseudouridine, 5-methylpseudouridine, 5-hydroxymethylpseudouridine, 5-carboxypseudouridine, 5-formylpseudouridine, and 5-methoxypseudouridine.

In some embodiments, at least about 50%, or at least about 55%%, or at least 60%, or at least 65%, or at least 70%, or at least 75%, or at least 80%, or at least 85%, or at least 90%, or at least 95%, or 100% of cytidine residues are non-canonical nucleotides selected from 5-hydroxycytidine, 5-methylcytidine, 5-hydroxymethylcytidine, 5-carboxycytidine, 5-formylcytidine, 5-methoxycytidine.

In some embodiments, at least about 20%, or about 30%, or about 40%, or about 50%, or at least about 55%, or at least 60%, or at least 65%, or at least 70%, or at least 75%, or at least 80%, or at least 85%, or at least 90%, or at least 95%, or 100% of uridine residues are non-canonical nucleotides selected from 5-hydroxyuridine, 5-methyluridine, 5-hydroxymethyluridine, 5-carboxyuridine, 5-formyluridine, 5-methoxyuridine, pseudouridine, 5-hydroxypseudouridine, 5-methylpseudouridine, 5-hydroxymethylpseudouridine, 5-carboxypseudouridine, 5-formylpseudouridine, and 5-methoxypseudouridine.

In some embodiments, at least about 10% (e.g. 10%, or about 20%, or about 30%, or about 40%, or about 50%) of guanosine residues are non-canonical nucleotides, and the non-canonical nucleotide is optionally 7-deazaguanosine. In some embodiments, the RNA contains no more than about 50% 7-deazaguanosine in place of guanosine residues.

In some embodiments, the RNA does not contain non-canonical nucleotides in place of adenosine residues.

Note that alternative naming schemes exist for certain non-canonical nucleotides. For example, in certain situations, 5-methylpseudouridine can be referred to as "3-methylpseudouridine" or "N3-methylpseudouridine" or "1-methylpseudouridine" or "N1-methylpseudouridine".

Nucleotides that contain the prefix "amino" can refer to any nucleotide that contains a nitrogen atom bound to the atom at the stated position of the nucleotide, for example, 5-aminocytidine can refer to 5-aminocytidine, 5-methylaminocytidine, and 5-nitrocytidine. Similarly, nucleotides that contain the prefix "methyl" can refer to any nucleotide that contains a carbon atom bound to the atom at the stated position of the nucleotide, for example, 5-methylcytidine can refer to 5-methylcytidine, 5-ethylcytidine, and 5-hydroxymethylcytidine, nucleotides that contain the prefix "thio" can refer to any nucleotide that contains a sulfur atom bound to the atom at the given position of the nucleotide, and nucleotides that contain the prefix "hydroxy" can refer to any nucleotide that contains an oxygen atom bound to the atom at the given position of the nucleotide, for example, 5-hydroxyuridine can refer to 5-hydroxyuridine and uridine with a methyl group bound to an oxygen atom, wherein the oxygen atom is bound to the atom at the 5C position of the uridine.

Certain embodiments are therefore directed to RNA comprising one or more non-canonical nucleotides, wherein the RNA molecule contains one or more nucleotides that includes one or more substitutions at the 2C and/or 4C and/or 5C positions in the case of a pyrimidine or the 6C and/or 7N and/or 8C positions in the case of a purine. Other embodiments are directed to a therapeutic, wherein the therapeutic contains one or more RNA molecules comprising one or more non-canonical nucleotides, and wherein the one or more RNA molecules comprising one or more non-canonical nucleotides contains one or more nucleotides that includes one or more substitutions at the 2C and/or 4C and/or 5C positions in the case of a pyrimidine or the 6C and/or 7N and/or 8C positions in the case of a purine. In one embodiment, the therapeutic comprises a transfection reagent. In another embodiment, the transfection reagent comprises a cationic lipid, liposome or micelle. In still another embodiment, the liposome or micelle comprises folate and the therapeutic composition has anti-cancer activity. In another embodiment, the one or more nucleotides includes at least one of pseudouridine, 2-thiouridine, 4-thiouridine, 5-azauridine, 5-hydroxyuridine, 5-methyluridine, 5-aminouridine, 2-thiopseudouridine, 4-thiopseudouridine, 5-hydroxypseudouridine, 5-methylpseudouridine, 5-aminopseudouridine, pseudoisocytidine, N4-methylcytidine, 2-thiocytidine, 5-azacytidine, 5-hydroxycytidine, 5-aminocytidine, 5-methylcytidine, N4-methylpseudoisocytidine, 2-thiopseudoisocytidine, 5-hydroxypseudoisocytidine, 5-aminopseudoisocytidine, 5-methylpseudoisocytidine, 7-deazaadenosine, 7-deazaguanosine, 6-thioguanosine, and 6-thio-7-deazaguanosine. In another embodiment, the one or more nucleotides includes at least one of pseudouridine, 2-thiouridine, 4-thiouridine, 5-azauridine, 5-hydroxyuridine, 5-methyluridine, 5-aminouridine, 2-thiopseudouridine, 4-thiopseudouridine, 5-hydroxypseudouridine, 5-methylpseudouridine, and 5-aminopseudouridine and at least one of pseudoisocytidine, N4-methylcytidine, 2-thiocytidine, 5-azacytidine, 5-hydroxycytidine, 5-aminocytidine, 5-methylcytidine, N4-methylpseudoisocytidine, 2-thiopseudoisocytidine, 5-hydroxypseudoisocytidine, 5-aminopseudoisocytidine, and 5-methylpseudoisocytidine. In still another embodiment, the one or more nucleotides include at least one of pseudouridine, 2-thiouridine, 4-thiouridine, 5-azauridine, 5-hydroxyuridine, 5-methyluridine, 5-aminouridine, 2-thiopseudouridine, 4-thiopseudouridine, 5-hydroxypseudouridine, and 5-methylpseudouridine, 5-aminopseudouridine and at least one of pseudoisocytidine, N4-methylcytidine, 2-thiocytidine, 5-azacytidine, 5-hydroxycytidine, 5-aminocytidine, 5-methylcytidine, N4-methylpseudoisocytidine, 2-thiopseudoisocytidine, 5-hydroxypseudoisocytidine, 5-aminopseudoisocytidine, and 5-methylpseudoisocytidine and at least one of 7-deazaguanosine, 6-thioguanosine, 6-thio-7-deazaguanosine, and 5-methoxyuridine. In yet another embodiment, the one or more nucleotides includes: 5-methylcytidine and 7-deazaadenosine. In another embodiment, the one or more nucleotides also includes pseudouridine or 4-thiouridine or 5-methyluridine or 5-aminouridine or 4-thiopseudouridine or 5-methylpseudouridine or 5-aminopseudouridine. In a still another embodiment, the one or more nucleotides also includes 7-deazaadenosine. In another embodiment, the one or more nucleotides includes: pseudoisocytidine and 7-deazaguanosine and 4-thiouridine. In yet another embodiment, the one or more nucleotides includes: pseudoisocytidine or 7-deazaguanosine and pseudouridine. In still another embodiment, the one or more nucleotides includes: 5-methyluridine and 5-methylcytidine and 7-deazaguanosine. In a further embodiment, the one or more nucleotides includes: pseudouridine or 5-methylpseudouridine and 5-methylcytidine and 7-deazaguanosine. In another embodiment, the one or more nucleotides includes: pseudoisocytidine and 7-deazaguanosine and pseudouridine. In one embodiment, the RNA comprising one or more non-canonical nucleotides is present in vivo.

Certain non-canonical nucleotides can be incorporated more efficiently than other non-canonical nucleotides into RNA molecules by RNA polymerases that are commonly used for in vitro transcription, due in part to the tendency of these certain non-canonical nucleotides to participate in standard base-pairing interactions and base-stacking interactions, and to interact with the RNA polymerase in a manner similar to that in which the corresponding canonical nucleotide interacts with the RNA polymerase. As a result, certain nucleotide mixtures containing one or more non-canonical nucleotides can be beneficial in part because in vitro-transcription reactions containing these nucleotide mixtures can yield a large quantity of RNA. Certain embodiments are therefore directed to a nucleotide mixture containing one or more nucleotides that includes one or more substitutions at the 2C and/or 4C and/or 5C positions in the case of a pyrimidine or the 6C and/or 7N and/or 8C positions in the case of a purine. Nucleotide mixtures include, but are not limited to (numbers preceding each nucleotide indicate an exemplary fraction of the non-canonical nucleotide triphosphate in an in vitro-transcription reaction, for example, 0.2 pseudoisocytidine refers to a reaction containing adenosine-5'-triphosphate, guanosine-5'-triphosphate, uridine-5'-triphosphate, cytidine-5'-triphosphate, and pseudoisocytidine-5'-triphosphate, wherein pseudoisocytidine-5'-triphosphate is present in the reaction at an amount approximately equal to 0.2 times the total amount of pseudoisocytidine-5'-triphosphate+cytidine-5'-triphosphate that is present in the reaction, with amounts measured either on a molar or mass basis, and wherein more than one number preceding a nucleoside indicates a range of exemplary fractions): 1.0 pseudouridine, 0.1-0.8 2-thiouridine, 0.1-0.8 5-methyluridine, 0.2-1.0 5-hydroxyuridine, 0.2-1.0 5-methoxyuridine, 0.1-1.0 5-aminouridine, 0.1-1.0 4-thiouridine, 0.1-1.0 2-thiopseudouridine, 0.1-1.0 4-thiopseudouridine, 0.1-1.0 5-hydroxypseudouridine, 0.2-1 5-methylpseudouridine, 0.2-1.0 5-methoxypseudouridine, 0.1-1.0 5-aminopseudouridine, 0.2-1.0 2-thiocytidine, 0.1-0.8 pseudoisocytidine, 0.2-1.0 5-methylcytidine, 0.2-1.0 5-hydroxycytidine, 0.2-1.0 5-hydroxymethylcytidine, 0.2-1.0 5-methoxycytidine, 0.1-1.0 5-aminocytidine, 0.2-1.0 N4-methylcytidine, 0.2-1.0 5-methylpseudoisocytidine, 0.2-1.0 5-hydroxypseudoisocytidine, 0.2-1.0 5-aminopseudoisocytidine, 0.2-1.0 N4-methylpseudoisocytidine, 0.2-1.0 2-thiopseudoisocytidine, 0.2-1.0 7-deazaguanosine, 0.2-1.0 6-thioguanosine, 0.2-1.0 6-thio-7-deazaguanosine, 0.2-1.0 8-azaguanosine, 0.2-1.0 7-deaza-8-azaguanosine, 0.2-1.0 6-thio-8-azaguanosine, 0.1-0.5 7-deazaadenosine, and 0.1-0.5 N6-methyladenosine.

In various embodiments, the RNA comprising one or more non-canonical nucleotides composition or synthetic polynucleotide composition (e.g., which may be prepared by in vitro transcription) contains substantially or entirely the canonical nucleotide at positions having adenine or "A" in the genetic code. The term "substantially" in this context refers to at least 90%. In these embodiments, the RNA composition or synthetic polynucleotide composition may further contain (e.g., consist of) 7-deazaguanosine at positions with "G" in the genetic code as well as the corresponding canonical nucleotide "G", and the canonical and non-canonical nucleotide at positions with G may be in the range of 5:1 to 1:5, or in some embodiments in the range of 2:1 to 1:2. In these embodiments, the RNA composition or synthetic polynucleotide composition may further contain (e.g., consist of) one or more (e.g., two, three or four) of 5-hydroxycytidine, 5-methylcytidine, 5-hydroxymethylcytidine, 5-carboxycytidine, 5-formylcytidine, 5-methoxycytidine at positions with "C" in the genetic code as well as the canonical nucleotide "C", and the canonical and non-canonical nucleotide at positions with C may be in the range of 5:1 to 1:5, or in some embodiments in the range of 2:1 to 1:2. In some embodiments, the level of non-canonical nucleotide at positions of "C" are as described in the preceding paragraph. In these embodiments, the RNA composition or synthetic polynucleotide composition may further contain (e.g., consist of) one or more (e.g., two, three, or four) of 5-hydroxyuridine, 5-methyluridine, 5-hydroxymethyluridine, 5-carboxyuridine, 5-formyluridine, 5-methoxyuridine, pseudouridine, 5-hydroxypseudouridine, 5-methylpseudouridine, 5-hydroxymethylpseudouridine, 5-carboxypseudouridine, 5-formylpseudouridine, and 5-methoxypseudouridineat positions with "U" in the genetic code as well as the canonical nucleotide "U", and the canonical and non-canonical nucleotide at positions with "U" may be in the range of 5:1 to 1:5, or in some embodiments in the range of 2:1 to 1:2. In some embodiments, the level of non-canonical nucleotide at positions of "U" are as described in the preceding paragraph.

It has now been discovered that combining certain non-canonical nucleotides can be beneficial in part because the contribution of non-canonical nucleotides to lowering the toxicity of RNA molecules can be additive. Certain embodiments are therefore directed to a nucleotide mixture, wherein the nucleotide mixture contains more than one of the non-canonical nucleotides listed above, for example, the nucleotide mixture contains both pseudoisocytidine and 7-deazaguanosine or the nucleotide mixture contains both N4-methylcytidine and 7-deazaguanosine, etc. In one embodiment, the nucleotide mixture contains more than one of the non-canonical nucleotides listed above, and each of the non-canonical nucleotides is present in the mixture at the fraction listed above, for example, the nucleotide mixture contains 0.1-0.8 pseudoisocytidine and 0.2-1.0 7-deazaguanosine or the nucleotide mixture contains 0.2-1.0 N4-methylcytidine and 0.2-1.0 7-deazaguanosine, etc.

In certain situations, for example, when it may not be necessary or desirable to maximize the yield of an in vitro-transcription reaction, nucleotide fractions other than those given above may be used. The exemplary fractions and ranges of fractions listed above relate to nucleotide-triphosphate solutions of typical purity (greater than 90% purity). Larger fractions of these and other nucleotides can be used by using nucleotide-triphosphate solutions of greater purity, for example, greater than about 95% purity or greater than about 98% purity or greater than about 99% purity or greater than about 99.5% purity, which can be achieved, for example, by purifying the nucleotide triphosphate solution using existing chemical-purification technologies such as high-pressure liquid chromatography (HPLC) or by other means. In one embodiment, nucleotides with multiple isomers are purified to enrich the desired isomer.

Other embodiments are directed to a method for inducing a cell in vivo to express a protein of interest by contacting the cell with a RNA molecule that contains one or more non-canonical nucleotides that includes one or more substitutions at the 2C and/or 4C and/or 5C positions in the case of a pyrimidine or the 6C and/or 7N and/or 8C positions in the case of a purine. Still other embodiments are directed to a method for transfecting, reprogramming, and/or gene-editing a cell in vivo by contacting the cell with a RNA molecule that contains one or more non-canonical nucleotides that includes one or more substitutions at the 2C and/or 4C and/or 5C positions in the case of a pyrimidine or the 6C and/or 7N and/or 8C positions in the case of a purine. In one embodiment, the RNA molecule is produced by in vitro transcription. In one embodiment, the RNA molecule encodes one or more reprogramming factors. In another embodiment, the one or more reprogramming factors includes Oct4 protein. In another embodiment, the cell is also contacted with a RNA molecule that encodes Sox2 protein. In yet another embodiment, the cell is also contacted with a RNA molecule that encodes Klf4 protein. In yet another embodiment, the cell is also contacted with a RNA molecule that encodes c-Myc protein. In yet another embodiment, the cell is also contacted with a RNA molecule that encodes Lin28 protein.

Enzymes such as T7 RNA polymerase may preferentially incorporate canonical nucleotides in an in vitro-transcription reaction containing both canonical and non-canonical nucleotides. As a result, an in vitro-transcription reaction containing a certain fraction of a non-canonical nucleotide may yield RNA containing a different, often lower, fraction of the non-canonical nucleotide than the fraction at which the non-canonical nucleotide was present in the reaction. In certain embodiments, references to nucleotide incorporation fractions (for example, "a synthetic RNA molecule containing 50% pseudoisocytidine" or "0.1-0.8 pseudoisocytidine") therefore can refer both to RNA molecules containing the stated fraction of the nucleotide, and to RNA molecules synthesized in a reaction containing the stated fraction of the nucleotide (or nucleotide derivative, for example, nucleotide-triphosphate), even though such a reaction may yield RNA containing a different fraction of the nucleotide than the fraction at which the non-canonical nucleotide was present in the reaction.

Different nucleotide sequences can encode the same protein by utilizing alternative codons. In certain embodiments, references to nucleotide incorporation fractions therefore can refer both to RNA molecules containing the stated fraction of the nucleotide, and to RNA molecules encoding the same protein as a different RNA molecule, wherein the different RNA molecule contains the stated fraction of the nucleotide.

Certain embodiments are directed to a kit containing one or more materials needed to practice the present invention. In one embodiment, the kit contains one or more synthetic RNA molecules. In one embodiment, the kit contains one or more synthetic RNA molecules that encode one or more reprogramming factors and/or gene-editing proteins. In another embodiment, the one or more synthetic RNA molecules contain one or more non-canonical nucleotides that include one or more substitutions at the 2C and/or 4C and/or 5C positions in the case of a pyrimidine or the 6C and/or 7N and/or 8C positions in the case of a purine. In another embodiment, the kit contains one or more of: a transfection medium, a transfection reagent, a complexation medium, and a matrix solution. In one embodiment, the matrix solution contains fibronectin and/or vitronectin or recombinant fibronectin and/or recombinant vitronectin. In one embodiment, one or more of the components of the kit are present as a plurality of aliquots. In one embodiment, the kit contains aliquots of nucleic acid transfection-reagent complexes. In another embodiment, the kit contains aliquots of nucleic acid transfection-reagent complexes that are provided in a solid form, for example, as frozen or freeze-dried pellets. In yet another embodiment, the kit contains aliquots of medium, wherein each aliquot contains transfection reagent-nucleic acid complexes that are stabilized either by chemical treatment or by freezing.

Transfection, in general, and reprogramming, in particular, can be difficult and time-consuming techniques that can be repetitive and prone to error. However, these techniques are often performed manually due to the lack of automated transfection equipment. Certain embodiments are therefore directed to a system that can transfect, reprogram, and/or gene-edit cells in vivo in an automated or semi-automated manner.

It has now been discovered that the non-canonical nucleotide members of the 5-methylcytidine de-methylation pathway, when incorporated into synthetic RNA, can increase the efficiency with which the synthetic RNA can be translated into protein in vivo, and can decrease the toxicity of the synthetic RNA in vivo. These non-canonical nucleotides include, for example: 5-methylcytidine, 5-hydroxymethylcytidine, 5-formylcytidine, and 5-carboxycytidine (a.k.a. "cytidine-5-carboxylic acid"). Certain embodiments are therefore directed to a nucleic acid. In some embodiments, the nucleic acid is present in vivo. In one embodiment, the nucleic acid is a synthetic RNA molecule. In another embodiment, the nucleic acid comprises one or more non-canonical nucleotides. In one embodiment, the nucleic acid comprises one or more non-canonical nucleotide members of the 5-methylcytidine de-methylation pathway. In another embodiment, the nucleic acid comprises at least one of: 5-methylcytidine, 5-hydroxymethylcytidine, 5-formylcytidine, and 5-carboxycytidine or a derivative thereof. In a further embodiment, the nucleic acid comprises at least one of: pseudouridine, 5-methylpseudouridine, 5-hydroxyuridine, 5-methyluridine, 5-methylcytidine, 5-hydroxymethylcytidine, N4-methylcytidine, N4-acetylcytidine, and 7-deazaguanosine or a derivative thereof.

5-Methylcytidine De-Methylation Pathway

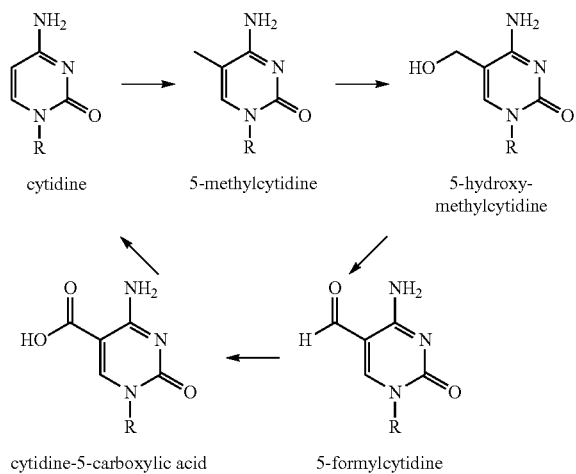

Certain embodiments are directed to a protein. Other embodiments are directed to a nucleic acid that encodes a protein. In one embodiment, the protein is a protein of interest. In another embodiment, the protein is selected from: a reprogramming protein and a gene-editing protein. In one embodiment, the nucleic acid is a plasmid. In another embodiment, the nucleic acid is present in a virus or viral vector. In a further embodiment, the virus or viral vector is replication incompetent. In a still further embodiment, the virus or viral vector is replication competent. In one embodiment, the virus or viral vector includes at least one of: an adenovirus, a retrovirus, a lentivirus, a herpes virus, an adeno-associated virus or a natural or engineered variant thereof, and an engineered virus.

It has also been discovered that certain combinations of non-canonical nucleotides can be particularly effective at increasing the efficiency with which synthetic RNA can be translated into protein in vivo, and decreasing the toxicity of synthetic RNA in vivo, for example, the combinations: 5-methyluridine and 5-methylcytidine, 5-hydroxyuridine and 5-methylcytidine, 5-hydroxyuridine and 5-hydroxymethylcytidine, 5-methyluridine and 7-deazaguanosine, 5-methylcytidine and 7-deazaguanosine, 5-methyluridine, 5-methylcytidine, and 7-deazaguanosine, and 5-methyluridine, 5-hydroxymethylcytidine, and 7-deazaguanosine. Certain embodiments are therefore directed to a nucleic acid comprising at least two of: 5-methyluridine, 5-methylcytidine, 5-hydroxymethylcytidine, and 7-deazaguanosine or one or more derivatives thereof. Other embodiments are directed to a nucleic acid comprising at least three of: 5-methyluridine, 5-methylcytidine, 5-hydroxymethylcytidine, and 7-deazaguanosine or one or more derivatives thereof. Other embodiments are directed to a nucleic acid comprising all of: 5-methyluridine, 5-methylcytidine, 5-hydroxymethylcytidine, and 7-deazaguanosine or one or more derivatives thereof. In one embodiment, the nucleic acid comprises one or more 5-methyluridine residues, one or more 5-methylcytidine residues, and one or more 7-deazaguanosine residues or one or more 5-methyluridine residues, one or more 5-hydroxymethylcytidine residues, and one or more 7-deazaguanosine residues.

It has been further discovered that synthetic RNA molecules containing certain fractions of certain non-canonical nucleotides and combinations thereof can exhibit particularly high translation efficiency and low toxicity in vivo. Certain embodiments are therefore directed to a nucleic acid comprising at least one of: one or more uridine residues, one or more cytidine residues, and one or more guanosine residues, and comprising one or more non-canonical nucleotides. In one embodiment, between about 20% and about 80% of the uridine residues are 5-methyluridine residues. In another embodiment, between about 30% and about 50% of the uridine residues are 5-methyluridine residues. In a further embodiment, about 40% of the uridine residues are 5-methyluridine residues. In one embodiment, between about 60% and about 80% of the cytidine residues are 5-methylcytidine residues. In another embodiment, between about 80% and about 100% of the cytidine residues are 5-methylcytidine residues. In a further embodiment, about 100% of the cytidine residues are 5-methylcytidine residues. In a still further embodiment, between about 20% and about 100% of the cytidine residues are 5-hydroxymethylcytidine residues. In one embodiment, between about 20% and about 80% of the guanosine residues are 7-deazaguanosine residues. In another embodiment, between about 40% and about 60% of the guanosine residues are 7-deazaguanosine residues. In a further embodiment, about 50% of the guanosine residues are 7-deazaguanosine residues. In one embodiment, between about 20% and about 80% or between about 30% and about 60% or about 40% of the cytidine residues are N4-methylcytidine and/or N4-acetylcytidine residues. In another embodiment, each cytidine residue is a 5-methylcytidine residue. In a further embodiment, about 100% of the cytidine residues are 5-methylcytidine residues and/or 5-hydroxymethylcytidine residues and/or N4-methylcytidine residues and/or N4-acetylcytidine residues and/or one or more derivatives thereof. In a still further embodiment, about 40% of the uridine residues are 5-methyluridine residues, between about 20% and about 100% of the cytidine residues are N4-methylcytidine and/or N4-acetylcytidine residues, and about 50% of the guanosine residues are 7-deazaguanosine residues. In one embodiment, about 40% of the uridine residues are 5-methyluridine residues and about 100% of the cytidine residues are 5-methylcytidine residues. In another embodiment, about 40% of the uridine residues are 5-methyluridine residues and about 50% of the guanosine residues are 7-deazaguanosine residues. In a further embodiment, about 100% of the cytidine residues are 5-methylcytidine residues and about 50% of the guanosine residues are 7-deazaguanosine residues. In a further embodiment, about 100% of the uridine residues are 5-hydroxyuridine residues. In one embodiment, about 40% of the uridine residues are 5-methyluridine residues, about 100% of the cytidine residues are 5-methylcytidine residues, and about 50% of the guanosine residues are 7-deazaguanosine residues. In another embodiment, about 40% of the uridine residues are 5-methyluridine residues, between about 20% and about 100% of the cytidine residues are 5-hydroxymethylcytidine residues, and about 50% of the guanosine residues are 7-deazaguanosine residues. In some embodiments, less than 100% of the cytidine residues are 5-methylcytidine residues. In other embodiments, less than 100% of the cytidine residues are 5-hydroxymethylcytidine residues. In one embodiment, each uridine residue in the synthetic RNA molecule is a pseudouridine residue or a 5-methylpseudouridine residue. In another embodiment, about 100% of the uridine residues are pseudouridine residues and/or 5-methylpseudouridine residues. In a further embodiment, about 100% of the uridine residues are pseudouridine residues and/or 5-methylpseudouridine residues, about 100% of the cytidine residues are 5-methylcytidine residues, and about 50% of the guanosine residues are 7-deazaguanosine residues.

Other non-canonical nucleotides that can be used in place of or in combination with 5-methyluridine include, but are not limited to: pseudouridine, 5-hydroxyuridine, 5-hydroxypseudouridine, 5-methoxyuridine, 5-methoxypseudouridine, 5-carboxyuridine, 5-carboxypseudouridine, 5-formyluridine, 5-formylpseudouridine, 5-hydroxymethyluridine, 5-hydroxymethylpseudouridine, and 5-methylpseudouridine (a.k.a. "1-methylpseudouridine", a.k.a. "N1-methylpseudouridine") or one or more derivatives thereof. Other non-canonical nucleotides that can be used in place of or in combination with 5-methylcytidine and/or 5-hydroxymethylcytidine include, but are not limited to: pseudoisocytidine, 5-methylpseudoisocytidine, 5-hydroxymethylcytidine, 5-formylcytidine, 5-carboxycytidine, 5-methoxycytidine, N4-methylcytidine, N4-acetylcytidine or one or more derivatives thereof. In certain embodiments, for example, when performing only a single transfection, injection or delivery or when the cells, tissue, organ or patient being transfected, injected or delivered to are not particularly sensitive to transfection-associated toxicity or innate-immune signaling, the fractions of non-canonical nucleotides can be reduced. Reducing the fraction of non-canonical nucleotides can be beneficial, in part, because reducing the fraction of non-canonical nucleotides can reduce the cost of the nucleic acid. In certain situations, for example, when minimal immunogenicity of the nucleic acid is desired, the fractions of non-canonical nucleotides can be increased.

Enzymes such as T7 RNA polymerase may preferentially incorporate canonical nucleotides in an in vitro-transcription reaction containing both canonical and non-canonical nucleotides. As a result, an in vitro-transcription reaction containing a certain fraction of a non-canonical nucleotide may yield RNA containing a different, often lower, fraction of the non-canonical nucleotide than the fraction at which the non-canonical nucleotide was present in the reaction. In certain embodiments, references to nucleotide incorporation fractions (for example, "50% 5-methyluridine") therefore can refer both to nucleic acids containing the stated fraction of the nucleotide, and to nucleic acids synthesized in a reaction containing the stated fraction of the nucleotide (or nucleotide derivative, for example, nucleotide-triphosphate), even though such a reaction may yield a nucleic acid containing a different fraction of the nucleotide than the fraction at which the non-canonical nucleotide was present in the reaction. In addition, different nucleotide sequences can encode the same protein by utilizing alternative codons. In certain embodiments, references to nucleotide incorporation fractions therefore can refer both to nucleic acids containing the stated fraction of the nucleotide, and to nucleic acids encoding the same protein as a different nucleic acid, wherein the different nucleic acid contains the stated fraction of the nucleotide.

Certain embodiments are directed to a nucleic acid comprising a 5'-cap structure selected from Cap 0, Cap 1, Cap 2, and Cap 3 or a derivative thereof. In one embodiment, the nucleic acid comprises one or more UTRs. In another embodiment, the one or more UTRs increase the stability of the nucleic acid. In a further embodiment, the one or more UTRs comprise an alpha-globin or beta-globin 5'-UTR. In a still further embodiment, the one or more UTRs comprise an alpha-globin or beta-globin 3'-UTR. In a still further embodiment, the synthetic RNA molecule comprises an alpha-globin or beta-globin 5'-UTR and an alpha-globin or beta-globin 3'-UTR. In one embodiment, the 5'-UTR comprises a Kozak sequence that is substantially similar to the Kozak consensus sequence. In another embodiment, the nucleic acid comprises a 3'-poly(A) tail. In a further embodiment, the 3'-poly(A) tail is between about 20 nt and about 250 nt or between about 120 nt and about 150 nt long. In a further embodiment, the 3'-poly(A) tail is about 20 nt, or about 30 nt, or about 40 nt, or about 50 nt, or about 60 nt, or about 70 nt, or about 80 nt, or about 90 nt, or about 100 nt, or about 110 nt, or about 120 nt, or about 130 nt, or about 140 nt, or about 150 nt, or about 160 nt, or about 170 nt, or about 180 nt, or about 190 nt, or about 200 nt, or about 210 nt, or about 220 nt, or about 230 nt, or about 240 nt, or about 250 nt long.

Certain embodiments are directed to methods of making nucleic acid drugs, including RNA comprising one or more non-canonical nucleotides. Such methods yield substantially stable RNA.

In various embodiments, the present methods and compositions find use in methods of treating, preventing or ameliorating a disease, disorder and/or condition. For instance, in some embodiments, the described methods of in vivo delivery, including various effective doses, administration strategies and formulations are used in a method of treatment.

In various embodiments, the present methods and compositions find use in methods of altering, modifying and/or changing a tissue (e.g. cosmetically).

In various embodiments, the present methods and compositions include using a nucleic acid drug, including a synthetic RNA, in the diagnosing, treating, preventing or ameliorating of a disease, disorder and/or condition described herein. In various embodiments, the present methods and compositions include using a nucleic acid drug, including a synthetic RNA, in the altering, modifying and/or changing of a tissue (e.g. cosmetically).

Generally speaking, in various embodiments, a synthetic RNA as described herein is administered to a human at specific doses described herein and the synthetic RNA comprises a sequence, sometimes referred to as a target sequence that encodes a protein of interest, which may be a therapeutic protein.

Synthetic RNA comprising only canonical nucleotides can bind to pattern recognition receptors, can be recognized as a pathogen-associated molecular pattern, and can trigger a potent immune response in cells, which can result in translation block, the secretion of inflammatory cytokines, and cell death. It has now been discovered that synthetic RNA comprising certain non-canonical nucleotides can evade detection by the innate immune system, and can be translated at high efficiency into protein, including in humans. It has been further discovered that synthetic RNA comprising at least one of the non-canonical nucleotides described herein, including, for example, a member of the group: 5-methylcytidine, 5-hydroxycytidine, 5-hydroxymethylcytidine, 5-carboxycytidine, 5-formylcytidine, 5-methoxycytidine, pseudouridine, 5-hydroxyuridine, 5-methyluridine, 5-hydroxymethyluridine, 5-carboxyuridine, 5-methoxyuridine, 5-formyluridine, 5-hydroxypseudouridine, 5-methylpseudouridine, 5-hydroxymethylpseudouridine, 5-carboxypseudouridine, 5-methoxypseudouridine, and 5-formylpseudouridine can evade detection by the innate immune system, and can be translated at high efficiency into protein, including in humans. Certain embodiments are therefore directed to a method for inducing a cell to express a protein of interest comprising contacting a cell with synthetic RNA. Other embodiments are directed to a method for transfecting a cell with synthetic RNA comprising contacting a cell with a solution comprising one or more synthetic RNA molecules. Still other embodiments are directed to a method for treating a patient comprising administering to the patient synthetic RNA. In one embodiment, the synthetic RNA comprises at least one of the non-canonical nucleotides described herein, including, for example, a member of the group: 5-methylcytidine, 5-hydroxycytidine, 5-hydroxymethylcytidine, 5-carboxycytidine, 5-formylcytidine, 5-methoxycytidine, pseudouridine, 5-hydroxyuridine, 5-methyluridine, 5-hydroxymethyluridine, 5-carboxyuridine, 5-methoxyuridine, 5-formyluridine, 5-hydroxypseudouridine, 5-methylpseudouridine, 5-hydroxymethylpseudouridine, 5-carboxypseudouridine, 5-methoxypseudouridine, and 5-formylpseudouridine. In another embodiment, the synthetic RNA encodes a protein of interest. Exemplary RNAs may contain combinations and levels of non-canonical and non-canonical nucleotides as described elsewhere herein, including with respect to the expression of any protein of interest described herein. In yet another embodiment, the method results in the expression of the protein of interest. In a further embodiment, the method results in the expression of the protein of interest in the patient's skin.

Other embodiments are directed to a method for delivering a nucleic acid to a cell in vivo. Still other embodiments are directed to a method for inducing a cell in vivo to express a protein of interest. Still other embodiments are directed to a method for treating a patient. In one embodiment, the method comprises disrupting the stratum corneum. In another embodiment, the method comprises contacting a cell with a nucleic acid. In yet another embodiment, the method results in the cell internalizing the nucleic acid. In a further embodiment, the method results in the cell expressing the protein of interest. In a still further embodiment, the method results in the expression of the protein of interest in the patient. In a still further embodiment, the method results in the amelioration of one or more of the patient's symptoms. In a still further embodiment, the patient is in need of the protein of interest. In a still further embodiment, the patient is deficient in the protein of interest.

Still other embodiments are directed to a method for treating a patient comprising delivering to a patient a composition. In one embodiment, the composition comprises albumin that is treated with an ion-exchange resin or charcoal. In another embodiment, the composition comprises one or more nucleic acid molecules. In yet another embodiment, at least one of the one or more nucleic acid molecules encodes a protein of interest. In one embodiment, the method results in the expression of the protein in the patient's skin. In another embodiment, the method results in the expression of a therapeutically or cosmetically effective amount of the protein of interest in the patient. In yet another embodiment, the method comprises administering a steroid. In a further embodiment, the steroid is a member of the group: hydrocortisone and dexamethasone.

Some embodiments are directed to a therapeutic composition and/or methods of treatment comprising a nucleic acid molecule encoding one or more proteins, wherein at least one of the one or more proteins is an extracellular matrix protein. Still other embodiments are directed to a cosmetic composition comprising a nucleic acid molecule encoding one or more proteins, wherein at least one of the one or more proteins is an extracellular matrix protein.

Pigmentation disorders can cause severe symptoms in patients. It has now been discovered that pigmentation disorders can be treated by delivering to a patient a nucleic acid encoding tyrosinase. Certain embodiments are therefore directed to a method for treating a pigmentation disorder. Other embodiments are directed to a method for altering the pigmentation of a patient. In one embodiment, the method comprises delivering to a patient a nucleic acid encoding tyrosinase. Other embodiments are directed to a cosmetic composition comprising a nucleic acid encoding tyrosinase. Still other embodiments are directed to a therapeutic composition comprising a nucleic acid encoding tyrosinase. Still other embodiments are directed to a method for increasing the ultraviolet absorption of a patient's skin. In one embodiment the method comprises delivering to a patient a nucleic acid encoding tyrosinase. In another embodiment, the method results in an increase in the ultraviolet absorption of the patient's skin. Still other embodiments are directed to a method for reducing photodamage to a person's skin upon exposure to ultraviolet light. In one embodiment, the method results in the reduction of photodamage to the person's skin upon exposure to ultraviolet light. Still other embodiments are directed to a method for treating xeroderma pigmentosum. In one embodiment, the method comprises delivering to a patient a nucleic acid encoding tyrosinase. Still other embodiments are directed to a method for treating epidermolysis bullosa. In one embodiment, the method comprises delivering to a patient a nucleic acid encoding one or more of keratin 5, keratin 14, plectin, an integrin family member, laminin, a laminin subunit, collagen XVII, collagen VII or a biologically active fragment, variant, analogue or family-member thereof. In one embodiment, the method comprises delivering to a patient a nucleic acid encoding collagen type VII. In another embodiment, the method comprises delivering to a patient a nucleic acid encoding melanocortin 1 receptor. Still other embodiments are directed to a method for treating xerosis. In one embodiment, the method comprises delivering to a patient a nucleic acid encoding a hyaluronan synthase. In another embodiment, the patient is diagnosed with atopic dermatitis. In yet another embodiment, the patient is diagnosed with ichthyosis. Certain embodiments are directed to a method for treating a cosmetic condition. Other embodiments are directed to a method for inducing tissue healing. In one embodiment, the method comprises delivering to a patient a nucleic acid encoding a hyaluronan synthase. In another embodiment, the cosmetic condition is a member of the group: wrinkles, sagging skin, thin skin, discoloration, and dry skin. In yet another embodiment, the patient has had cataract surgery. In some embodiments, the nucleic acid is synthetic RNA. In other embodiments, the method results in the amelioration of one or more of the patient's symptoms. Other embodiments are directed to a method for treating an indication by delivering to a cell or a patient a nucleic acid encoding a protein or a peptide. Still other embodiments are directed to a composition comprising a nucleic acid encoding a protein or a peptide. Indications that can be treated using the methods and compositions of the present invention and proteins and peptides that can be encoded by compositions of the present invention are set forth in Table 2A and/or Table 2B, and are given by way of example, and not by way of limitation. In one embodiment, the indication is selected from Table 2A and/or Table 2B. In another embodiment the protein or peptide is selected from Table 2A and/or Table 2B. In yet another embodiment, the indication and the protein or peptide are selected from the same row of Table 2A and/or Table 2B. In a further embodiment, the protein of interest is a member of the group: UCP1, UCP2, and UCP3. Other embodiments are directed to methods for inducing a cell to express a plurality of proteins of interest. In one embodiment, the proteins of interest include at least two members of the group: a lipase, UCP1, UCP2, and UCP3. In another embodiment, the proteins of interest include a lipase and a member of the group: UCP1, UCP2, and UCP3. In another embodiment, the protein is a gene-editing protein. In yet another embodiment, the gene-editing protein targets a gene that is at least partly responsible for a disease phenotype. In yet another embodiment, the gene-editing protein targets a gene that encodes a protein selected from Table 2A and/or Table 2B. In still another embodiment, the gene-editing protein corrects or eliminates, either alone or in combination with one or more other molecules or gene-editing proteins, a mutation that is at least partly responsible for a disease phenotype.

In various embodiments, the present invention contemplates the targeting of the precursor forms and/or mature forms and/or isoforms and/or mutants of any of the proteins disclosed in Table 2A and/or Table 2B and such proteins. In some embodiments, any of the precursor forms and/or mature forms and/or isoforms and/or mutants have enhanced secretion relative to the corresponding wild type proteins. In some embodiments, any of the precursor forms and/or mature forms and/or isoforms and/or mutants have altered half-lives (e.g. serum, plasma, intracellular)—for instance, longer or shorter half-lives. In some embodiments, this is relative to wild type.

TABLE 2A

| Illustrative Indications | |
|---|---|
| Illustrative Indication | Illustrative Protein/Peptide |
| Acne | Retinol Dehydrogenase 10 |
| Aging | Elastin |
| | sp\|P15502\|ELN_HUMAN Elastin |
| | (isoform 3) |
| | (SEQ ID NO: 486) |
| Aging | Collagen Type I |
| | P02452\|CO1A1_HUMAN Collagen alpha-1(I) chain |
| | (SEQ ID NO: 487) |
| | P08123\|CO1A2_HUMAN Collagen alpha-2(I) chain |
| | (SEQ ID NO: 488) |
| Aging | Collagen Type III |
| | P02461\|CO3A1_HUMAN Collagen alpha-1(III) chain |
| | (isoform 1) |
| | (SEQ ID NO: 489) |
| Aging | Collagen Type VII |
| | Q02388\|CO7A1_HUMAN Collagen alpha-1(VII) chain |
| | (SEQ ID NO: 490) |
| Aging | Hyaluronan Synthase |
| Aging | Telomerase Reverse Transcriptase |
| Albinism | Tyrosinase |
| | P14679\|TYRO_HUMAN Tyrosinase |
| | (isoform 1) |
| | (SEQ ID NO: 491) |
| Alport Syndrome | Collagen Type IV |
| | P02462\|CO4A1_HUMAN Collagen alpha-1(IV) chain |
| | (isoform 1) |
| | (SEQ ID NO: 492) |
| | P08572\|CO4A2_HUMAN Collagen alpha-2(IV) chain |
| | (SEQ ID NO: 493) |
| | Q01955\|CO4A3_HUMAN Collagen alpha-3(IV) chain |
| | (isoform 1) |
| | (SEQ ID NO: 494) |
| | P53420\|CO4A4_HUMAN Collagen alpha-4(IV) chain |
| | (SEQ ID NO: 495) |
| | P29400\|CO4A5_HUMAN Collagen alpha-5(IV) chain |
| | (isoform 1) |
| | (SEQ ID NO: 496) |

TABLE 2A-continued

Illustrative Indications

| Illustrative Indication | Illustrative Protein/Peptide |
|---|---|
| | Q14031|CO4A6_HUMAN Collagen alpha-6(IV) (isoform A) (SEQ ID NO: 497) |
| Anemia | Erythropoietin |
| Atopic Dermatitis | Filaggrin |
| Cutis Laxa | Elastin sp|P15502|ELN_HUMAN Elastin (isoform 3) (SEQ ID NO: 486) |
| Dry Skin | Filaggrin |
| Dystrophic Epidermolysis Bullosa | Collagen Type VII Q02388|CO7A1_HUMAN Collagen alpha-1(VII) chain (SEQ ID NO: 498) |
| Ehlers-Danlos Syndrome | Collagen Type V P20908|CO5A1_HUMAN Collagen alpha-1(V) chain (SEQ ID NO: 499) P05997|CO5A2_HUMAN Collagen alpha-2(V) chain (SEQ ID NO: 500) P25940|CO5A3_HUMAN Collagen alpha-3(V) chain (SEQ ID NO: 501) |
| Ehlers-Danlos Syndrome | Collagen Type I P02452|CO1A1_HUMAN Collagen alpha-1(I) chain (SEQ ID NO: 487) P08123|CO1A2_HUMAN Collagen alpha-2(I) chain (SEQ ID NO: 488) |
| Epidermolysis bullosa, lethal acantholytic | ADAM17 P78536|ADA17_HUMAN Disintegrin and metalloproteinase domain-containing protein 17 (isoform A) (SEQ ID NO: 502) |
| Epidermolysis bullosa, type IV | Collagen Type III P02461|CO3A1_HUMAN Collagen alpha-1(III) chain (isoform 1) (SEQ ID NO: 489) |
| Erythropoietic Protoporphyria | Ferrochelatase P22830|HEMH_HUMAN Ferrochelatase, mitochondrial (isoform 1) (SEQ ID NO: 503) |
| Eczema | Filaggrin |
| Excess Fat | Thermogenin P25874|UCP1_HUMAN Mitochondrial brown fat uncoupling protein 1 (SEQ ID NO: 504) |
| Excess Fat | Lipase Lipoprotein lipase P06858|LIPL_HUMAN Lipoprotein lipase (SEQ ID NO: 516) Hepatic lipase P11150|LIPC_HUMAN Hepatic triacylglycerol lipase (SEQ ID NO: 517) Pancreatic lipase P16233|LIPP_HUMAN Pancreatic triacylglycerol lipase (SEQ ID NO: 518) Endothelial lipase (isoform 1) Q9Y5X9|LIPE_HUMAN Endothelial lipase (SEQ ID NO: 519) Lysosomal lipase P38571|LICH_HUMAN Lysosomal acid lipase/cholesteryl ester hydrolase (isoform 1) (SEQ ID NO: 520) Hormone sensitive lipase Q05469|LIPS_HUMAN Hormone-sensitive lipas (isoform 1) (SEQ ID NO: 521) Gastric lipase P07098|LIPG_HUMAN Gastric triacylglycerol lipase (isoform 1) (SEQ ID NO: 522) |

TABLE 2A-continued

| Illustrative Indications | |
|---|---|
| Illustrative Indication | Illustrative Protein/Peptide |
| | Pancreatic Lipase-Related Protein 1) |
| | P54315\|LIPR1_HUMAN Inactive pancreatic lipase-related protein 1 |
| | (isoform 1) |
| | (SEQ ID NO: 523) |
| | Pancreatic Lipase-Related Protein 2 |
| | P54317\|LIPR2_HUMAN Pancreatic lipase-related protein 2 |
| | (SEQ ID NO: 524) |
| | Carboxyl Ester Lipase |
| | P19835\|CEL_HUMAN Bile salt-activated lipase |
| | (isoform long) |
| | (SEQ ID NO: 525) |
| Hypotrichosis | ADAM17 |
| | P78536\|ADA17_HUMAN Disintegrin and metalloproteinase domain-containing protein 17 |
| | (isoform A) |
| | (SEQ ID NO: 502) |
| Ichthyosis Vulgaris | Filaggrin |
| Infections | Genetic Antibiotics (e.g. Anti-Sigma Factors) |
| Inflammatory and Bullous Skin Bowel Syndrome | Desmoglein 2 |
| | Q14126\|DSG2_HUMAN Desmoglein-2 |
| | (SEQ ID NO: 505) |
| Keratosis Pilaris | Retinol Dehydrogenase 10 |
| Oily Skin | Retinol Dehydrogenase 10 |
| Osteoarthritis | Hyaluronan Synthase |
| Pemphigus Vulgaris | Plakophilin-1 |
| | Q13835\|PKP1_HUMAN Plakophilin-1 |
| | (isoform 2) |
| | (SEQ ID NO: 506) |
| Pseudoxanthoma elasticum | Elastin |
| | sp\|P15502\|ELN_HUMAN Elastin |
| | (isoform 3) |
| | (SEQ ID NO: 486) |
| Psoriasis | Retinol Dehydrogenase 10 |
| Scar Treatment | Tyrosinase |
| | P14679\|TYRO_HUMAN Tyrosinase |
| | (isoform 1) |
| | (SEQ ID NO: 491) |
| Scarring | Elastin |
| | sp\|P15502\|ELN_HUMAN Elastin |
| | (isoform 3) |
| | (SEQ ID NO: 486) |
| Scarring | Collagen Type I |
| | P02452\|CO1A1_HUMAN Collagen alpha-1(I) chain |
| | (SEQ ID NO: 487) |
| | P08123\|CO1A2_HUMAN Collagen alpha-2(I) chain |
| | (SEQ ID NO: 488) |
| Scarring | Collagen Type III |
| | P02461\|CO3A1_HUMAN Collagen alpha-1(III) chain |
| | (isoform 1) |
| | (SEQ ID NO: 489) |
| Skin Cancer | Interferon |
| | Interferon, Alpha 1 |
| | P01562\|IFNA1_HUMAN Interferon alpha-1/13 |
| | (SEQ ID NO: 530) |
| | Interferon, Alpha 2 |
| | P01563\|IFNA2_HUMAN Interferon alpha-2 |
| | (SEQ ID NO: 531) |
| | Interferon, Alpha 4 |
| | P05014\|IFNA4_HUMAN Interferon alpha-4 |
| | (SEQ ID NO: 532) |
| | Interferon, Alpha 5 |
| | P01569\|IFNA5_HUMAN Interferon alpha-5 |
| | (SEQ ID NO: 533) |
| | Interferon, Alpha 6 |
| | P05013\|IFNA6_HUMAN Interferon alpha-6 |
| | (SEQ ID NO: 534) |
| | Interferon, Alpha 7 |
| | P01567\|IFNA7_HUMAN Interferon alpha-7 |
| | (SEQ ID NO: 535) |
| | Interferon, Alpha 8 |
| | P32881\|IFNA8_HUMAN Interferon alpha-8 |
| | (SEQ ID NO: 536) |

TABLE 2A-continued

| Illustrative Indications | |
|---|---|
| Illustrative Indication | Illustrative Protein/Peptide |
| | Interferon, Alpha 10 |
| | P01566\|IFN10_HUMAN Interferon alpha-10 |
| | (SEQ ID NO: 537) |
| | Interferon, Alpha 14 |
| | P01570\|IFN14_HUMAN Interferon alpha-14 OS |
| | (SEQ ID NO: 538) |
| | Interferon, Alpha 16 |
| | P05015\|IFN16_HUMAN Interferon alpha-16 |
| | (SEQ ID NO: 539) |
| | Interferon, Alpha 17 |
| | P01571\|IFN17_HUMAN Interferon alpha-17 |
| | (SEQ ID NO: 540) |
| | Interferon, Alpha 21 |
| | P01568\|IFN21_HUMAN Interferon alpha-21 |
| | (SEQ ID NO: 541) |
| | Interferon, Gamma |
| | P01579\|IFNG_HUMAN Interferon gamma |
| | (SEQ ID NO: 542) |
| | Interferon, Beta |
| | P01574\|IFNB_HUMAN Interferon beta |
| | (SEQ ID NO: 543) |
| | Interferon, Kappa |
| | Q9P0W0\|IFNK_HUMAN Interferon kappa |
| | (SEQ ID NO: 544) |
| | Interferon, Epsilon |
| | Q86WN2\|IFNE_HUMAN Interferon epsilon |
| | (SEQ ID NO: 545) |
| Striate Palmoplantar Keratoderma | ADAM17 |
| | P78536\|ADA17_HUMAN Disintegrin and |
| | metalloproteinase domain-containing protein 17 |
| | (isoform A) |
| | (SEQ ID NO: 502) |
| Tanning | Tyrosinase |
| | P14679\|TYRO_HUMAN Tyrosinase |
| | (isoform 1) |
| | (SEQ ID NO: 491) |
| Vitiligo | Melanocyte-Stimulating Hormone |
| | Alpha-MSH |
| | P01189\|138-150 |
| | (SEQ ID NO: 526) |
| | Beta-MSH |
| | P01189\|217-234 |
| | (SEQ ID NO: 527) |
| | Gamma-MSH |
| | P01189\|77-87 |
| | (SEQ ID NO: 528) |
| | Proopiomelanocortin |
| | P01189\|COLI_HUMAN Pro-opiomelanocortin |
| | (SEQ ID NO: 529) |
| Vitiligo | Tyrosinase |
| | P14679\|TYRO_HUMAN Tyrosinase |
| | (isoform 1) |
| | (SEQ ID NO: 491) |
| Warts | Interferon |
| | Interferon, Alpha 1 |
| | P01562\|IFNA1_HUMAN Interferon alpha-1/13 |
| | (SEQ ID NO: 530) |
| | Interferon, Alpha 2 |
| | P01563\|IFNA2_HUMAN Interferon alpha-2 |
| | (SEQ ID NO: 531) |
| | Interferon, Alpha 4 |
| | P05014\|IFNA4_HUMAN Interferon alpha-4 |
| | (SEQ ID NO: 532) |
| | Interferon, Alpha 5 |
| | P01569\|IFNA5_HUMAN Interferon alpha-5 |
| | (SEQ ID NO: 533) |
| | Interferon, Alpha 6 |
| | P05013\|IFNA6_HUMAN Interferon alpha-6 |
| | (SEQ ID NO: 534) |
| | Interferon, Alpha 7 |
| | P01567\|IFNA7_HUMAN Interferon alpha-7 |
| | (SEQ ID NO: 535) |
| | Interferon, Alpha 8 |
| | P32881\|IFNA8_HUMAN Interferon alpha-8 |
| | (SEQ ID NO: 536) |

TABLE 2A-continued

Illustrative Indications

| Illustrative Indication | Illustrative Protein/Peptide |
|---|---|
| | Interferon, Alpha 10<br>P01566\|IFN10_HUMAN Interferon alpha-10<br>(SEQ ID NO: 537)<br>Interferon, Alpha 14<br>P01570\|IFN14_HUMAN Interferon alpha-14 OS<br>(SEQ ID NO: 538)<br>Interferon, Alpha 16<br>P05015\|IFN16_HUMAN Interferon alpha-16<br>(SEQ ID NO: 539)<br>Interferon, Alpha 17<br>P01571\|IFN17_HUMAN Interferon alpha-17<br>(SEQ ID NO: 540)<br>Interferon, Alpha 21<br>P01568\|IFN21_HUMAN Interferon alpha-21<br>(SEQ ID NO: 541)<br>Interferon, Gamma<br>P01579\|IFNG_HUMAN Interferon gamma<br>(SEQ ID NO: 542)<br>Interferon, Beta<br>P01574\|IFNB_HUMAN Interferon beta<br>(SEQ ID NO: 543)<br>Interferon, Kappa<br>Q9P0W0\|IFNK_HUMAN Interferon kappa<br>(SEQ ID NO: 544)<br>Interferon, Epsilon<br>Q86WN2\|IFNE_HUMAN Interferon epsilon<br>(SEQ ID NO: 545) |
| Wound Healing | Elastin<br>sp\|P15502\|ELN_HUMAN Elastin<br>(isoform 3)<br>(SEQ ID NO: 486) |
| Wound Healing | Collagen Type I<br>P02452\|CO1A1_HUMAN Collagen alpha-1(I) chain<br>(SEQ ID NO: 487)<br>P08123\|CO1A2_HUMAN Collagen alpha-2(I) chain<br>(SEQ ID NO: 488) |
| Wound Healing | Collagen Type III<br>P02461\|CO3A1_HUMAN Collagen alpha-1(III) chain<br>(isoform 1)<br>(SEQ ID NO: 489) |
| Xeroderma Pigmentosum | DNA Polymerase Eta<br>Q9Y253\|POLH_HUMAN DNA polymerase eta<br>(isoform 1)<br>(SEQ ID NO: 507) |

Additional illustrative targets of the present invention include the cosmetic targets listed in Table 6 of International Patent Publication No. WO 2013/151671, the contents of which are hereby incorporated by reference in their entirety.

In various embodiments, the agents of the present invention are used in methods the effect the integumentary system of a human. The present compositions and methods may be used to alter a biological and/or physiological process to, for example, reduce skin sagging, increase skin thickness, increase skin volume, reduce the number of wrinkles, the length of wrinkles and/or the depth of wrinkles, increase skin tightness, firmness, tone and/or elasticity, increase skin hydration and ability to retain moisture, water flow and osmotic balance, increase the levels of skin lipids; increase the extracellular matrix and/or adhesion and communication polypeptides; increase skin energy production; utilization and conservation; improve oxygen utilization; improve skin cell life; improve skin cell immunity defense, heat shock stress response, antioxidant defense capacity to neutralize free radicals, and/or toxic defense; improve the protection and recovery from ultraviolet rays; improve skin cell communication and skin cell innervations; improve cell cohesion/adhesion; improve calcium mineral and other mineral metabolism; improve cell turnover; and improve cell circadian rhythms.

Further still, in some embodiments, the present compositions may be used in the treatment, control, or prevention of a disease, disorder and/or condition and/or may alter, modify or change the appearance of a member of the integumentary system of a subject suffering from a disease, disorder and/or condition such as, but not limited to, acne vulgaris, acne aestivalis, acne conglobata, acne cosmetic, acne fulminans, acne keloidalis nuchae, acne mechanica, acne medicamentosa, acne miliaris necrotica, acne necrotica, acne rosacea, actinic keratosis, acne vulgaris, acne aestivalis, acne conglobata, acne cosmetic, acne fulminans, acne keloidalis nuchae, acne mechanica, acne medicamentosa, acne miliaris necrotica, acne necrotica, acne rosacea, acute urticaria, allergic contact dermatitis, alopecia areata, angioedema, athlete's foot, atopic dermatitis, autoeczematization, baby acne, balding, bastomycosis, blackheads, birthmarks and other skin pigmentation problems, boils, bruises, bug bites and stings, burns, cellulitis, chiggers, chloracne, cholinergic or stress uricara, chronic urticaria, cold type urticaria, confluent and reticulated papillomatosis, corns, cysts, dandruff, dermatitis herpetiformis, dermatographism, dyshidrotic eczema, diaper rash, dry skin, dyshidrosis, ectodermal dysplasia such as, hyprohidrotic ectodermal dysplasia and X-linked hyprohidrotic ectodermal dysplasia, eczema, epidermaodysplasia verruciformis, erythema nodosum, excoriated acne, exercise-induced anaphylasis folliculitis, excess skin oil, folliculitis, freckles, frostbite, fungal nails, hair density, hair growth rate, halogen acne, hair loss, heat rash, hematoma, herpes simplex infections (e.g. non-genital), hidradenitis suppurativa, hives, hyperhidrosis, hyperpigmentation, hypohidrotic ectodermal dysplasia, hypopigmentation, impetigo, ingrown hair, heat type urticara, ingrown toenail, infantile acne or neonatal acne, itch, irritant contact dermatitis, jock itch, keloid, keratosis pilaris, lichen planus, lichen sclerosus, lupus miliaris disseminatus faciei, melasma, moles, molluscum contagiosum, nail growth rate, nail health, neurodermatitis, nummular eczema, occupational acne, oil acne, onychomycosis, physical urticaria, pilonidal cyst, pityriasis rosea, pityriasis versicolor, poison ivy, pomade acne, pseudofolliculitis barbae or acne keloidalis nuchae, psoriasis, psoriatic arthritis, pressure or delayed pressure urticara, puncture wounds such as cuts and scrapes, rash, rare or water type urticara, rhinoplasty, ringworm, rosacea, rothmund-thomson syndrome, sagging of the skin, scabis, scars, seborrhea, seborrheic dermatitis, shingles, skin cancer, skin tag, solar type urticara, spider bite, stretch marks, sunburn, tar acne, tropical acne, thinning of skin, thrush, tinea versicolor, transient acantholytic dermatosis, tycoon's cap or acne necrotica miliaris, uneven skin tone, varicose veins, venous eczema, vibratory angioedema, vitiligo, warts, Weber-Christian disease, wrinkles, x-linked hypohidrotic ectodermal dysplasia, xerotic eczema, yeast infection and general signs of aging.

In some embodiments, there is provided methods of treating, controlling or preventing dry skin with the present compositions. In some embodiments profilaggrin (a protein which is converted to filaggrin) is a protein of interest (e.g. when treating ichthyosis vulgaris).

In some embodiments, there is provided methods of treating, controlling or preventing any one of the various types of psoriasis (e.g. plague psoriasis, guttate psoriasis, pustular psoriasis, inverse psoriasis, and erythrodermic psoriasis). In various embodiments, the protein of interest is any of the products of the genes psoriasis susceptibility 1 through 9 (PSORSI-PSORS9).

Various embodiments relate to the treatment, control, or prevention of eczema (e.g. atopic dermatitis, nummular eczema, dyshidrotic eczema, seborrheic dermatitis, irritant contact dermatitis, allergic contact dermatitis, dyshidrosis, venous eczema, dermatitis herpetiformis, neurodermatitis, autoeczematization and xerotic eczema) and, optionally, one or more of the following may be targeted: filaggrin; three genetic variants, ovo-like 1 (OVOL1), actin-like 9 (ACTL9) and kinesin family member 3 A (KIF3A) have been associated with eczema; and the genes brain-derived neurotrophic factor (BDNF) and tachykinin, precursor 1 (TAC1).

Hives, or urticaria, including, but not limited to, acute urticaria, chronic urticara and angioedema, physical urticara, pressure or delayed pressure urticara, cholinergic or stress uricara, cold type urticara, heat type urticara, solar type urticara, rare or water type urticara, vibratory angioedema, exercise-induced anaphylasis and dermatographism may be treated with the present compositions by, for example, targeting PLCG-2.

Various embodiments relate to the treatment, control, or prevention of rosacea, which includes, but is not limited to, erthematotelangiectatic rosacea, papulopustular rosacea, phymatous rosacea, and ocular rosacea. Optionally, cathelicidin antimicrobial peptide (CAMP) and/or kallikrein-related peptidase 5 (also known as stratum corneum tryptic enzyme (SCTE)) are proteins of interest.

In some embodiments, there is provided methods of treating, controlling or preventing acne with the present compositions. For example, acne may include, but is not limited to, acneiform eruptions, acne aestivalis, acne conglobata, acne cosmetic, acne fulminans, acne keloidalis nuchae, acne mechanica, acne medicamentosa, acne miliaris necrotica, acne necrotica, acne rosacea, baby acne, blackheads, chloracne, excoriated acne, halogen acne, infantile acne or neonatal acne, lupus miliaris disseminatus faciei, occupational acne, oil acne, pomade acne, tar acne, tropical acne, tycoon's cap or acne necrotica miliaris, pseudofolliculitis barbae or acne keloidalis nuchae, and hidradenitis suppurativa. In these embodiments, the protein of interest may be one or more matrix metalloproteinases (MMP), e.g., matrix metalloproteinase-1 (MMP-1 or interstitial collagenase), matrix metalloproteinase-9 (MMP-9), and matrix metalloproteinase-13 (MMP-13).

In further embodiments, vitiligo is treated with the present compositions, e.g. wherein the NLR family, pyrin domain containing 1 gene (NALP1) gene is targeted.

In some embodiments, the present compositions find use in the treatment, control, or prevention of hyprohidrotic ectodermal dysplasia (HED), e.g. via the ectodysplasin A gene (EDA), receptor (EDAR), and receptor associated death domain (EDARADD).

In some embodiments, the present compositions find use in the treatment, control, or prevention of balding, or hair thinning (e.g. male pattern baldness, or androgenetic alopecia (AGA)) and, optionally, one or more of the following may be the protein of interest: androgen receptor (AR), ectodysplasin A2 receptor (EDA2R) and lysophosphatidic acid receptor 6 (P2RY5).

The present compositions also find use in methods of treatment, control, or prevention of scars and stretch marks (striae), e.g. via collagen, ribosomal s6 kinase, sectrected phosphoprotein 1 (also known as osteopontin), or transforming growth factor beta 3.

Epidermodysplasia verruciformis (also known as Lutz-Lewandowsky epidermodysplasia), a rare autosomal recessive genetic hereditary skin disorder, may also be treated with compositions of the present invention, e.g. by targeted transmembrane channel-like 6 (EVER1) or transmembrane channel like 8 (EVER2) genes.

In some embodiments, skin sagging, thinning or wrinkling may be treated, controlled or prevented with present composition, e.g. by targeting one or more of the proteins of interest such as collagen, elastin, fibroblast growth factor 7, TIMP metallopeptidase inhibitors, matrix metallopeptidases, superoxide dismutase and other extracellular matrix proteins and proteoglycans.

Further embodiments are used in tanning of the skin, such as via melanocyte-stimulating hormone and/or proopiomelanocortin.

In some embodiments, the present compositions may be used for wound treatment. In some embodiments, methods of treating, controlling or preventing wounds with the present compositions comprises additional steps of, for example, cleaning the wound bed to facilitate wound healing and closure, including, but not limited to: debridement, sharp debridement (surgical removal of dead or infected tissue from a wound), optionally including chemical debriding agents, such as enzymes, to remove necrotic tissue; wound dressings to provide the wound with a moist, warm environment and to promote tissue repair and healing (e.g., wound dressings comprising hydrogels (e.g., AQUASORB;

DUODERM), hydrocolloids (e.g., AQUACEL; COMFEEL), foams (e.g., LYOFOAM; SPYROSORB), and alginates (e.g., ALGISITE; CURASORB); administration of growth factors to stimulate cell division and proliferation and to promote wound healing e.g. becaplermin; and (iv) soft-tissue wound coverage, a skin graft may be necessary to obtain coverage of clean, non-healing wounds (e.g., autologous skin grafts, cadaveric skin graft, bioengineered skin substitutes (e.g., APLIGRAF; DERMAGRAFT)).

In various embodiments, the nucleic acid drug described herein can be used in a variety of cosmetic/plastic surgery procedures, including, without limitation, a surgical procedure involving skin grafting and an aesthetic or cosmetic surgery (e.g. a facial plastic surgery procedure including, but not limited to blepharoplasty, rhinoplasty, rhytidectomy, genioplasty, facial implants, otoplasty, hair implantation, cleft lip and cleft palate repair, and/or a body plastic surgery procedure including but not limited to abdominoplasty, brachioplasty, thigh lift, breast reduction, breast augmentation, body contouring, liposuction, hand surgery).

In various embodiments, a variety of cancers are treated, controlled or prevented with the present compositions (e.g., colorectal cancer, gallbladder cancer, lung cancer, pancreatic cancer, and stomach cancer). In some embodiments, skin cancer is treated with the present compositions. For instance, the skin cancer is one or more of actinic keratosis, basal cell carcinoma, melanoma, Kaposi's sarcoma, and squamous cell carcinoma. In some embodiments, the present compositions are used adjuvant to complete circumferential peripheral and deep margin assessment, Mohs surgery, radiation (e.g. external beam radiotherapy or brachytherapy), chemotherapy (including but not limited to topical chemotherapy, e.g. with imiquimod or 5-fluorouracil), and cryotherapy. The present compositions also find use in the treatment of various stages of cancers, including skin cancers (e.g. basal cell cancer (BCC), squamous cell cancer (SCC), and melanoma), such as a stage of the American Joint Committee on Cancer (AJCC) TNM system (e.g. one or more of TX, T0, Tis, T1, T1a, T1b, T2, T2A, T2B, T3, T3a, T3b, T4, T4a, T4b, NX, N0, N1, N2, N3, M0, M1a, M1b, M1c) and/or a staging system (e.g. Stage 0, Stage IA, Stage IB, Stage IIA, Stage IIB, Stage IIC, Stage IIIA, Stage IIIB, Stage IIIC, Stage IV).

Illustrative cancers and/or tumors of the present invention include, but are not limited to, a basal cell carcinoma, biliary tract cancer; bladder cancer; bone cancer; brain and central nervous system cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma; hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); melanoma; myeloma; neuroblastoma; oral cavity cancer (lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; lymphoma including Hodgkin's and non-Hodgkin's lymphoma, as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia; chronic lymphocytic leukemia (CLL); acute lymphoblastic leukemia (ALL); Hairy cell leukemia; chronic myeloblastic leukemia; as well as other carcinomas and sarcomas; and post-transplant lymphoproliferative disorder (PTLD), as well as abnormal vascular proliferation associated with phakomatoses, edema (such as that associated with brain tumors), and Meigs' syndrome.

In various embodiments, one or more rare diseases are treated, controlled or prevented with the present compositions, including, by way of illustration, Erythropoietic Protoporphyria, Hailey-Hailey Disease, Epidermolysis Bullosa (EB), Xeroderma Pigmentosum, Ehlers-Danlos Syndrome, Cutis Laxa, Protein C & Protein S Deficiency, Alport Syndrome, Striate Palmoplantar Keratoderma, Lethal Acantholytic EB, Pseudoxanthoma Elasticum (PXE), Ichthyosis Vulgaris, Pemphigus Vulgaris, and Basal Cell Nevus Syndrome.

In various embodiments, the present compositions are used to treat, control or prevent one or more inflammatory diseases or conditions, such as inflammation, acute inflammation, chronic inflammation, respiratory disease, atherosclerosis, restenosis, asthma, allergic rhinitis, atopic dermatitis, septic shock, rheumatoid arthritis, inflammatory bowel disease, inflammatory pelvic disease, pain, ocular inflammatory disease, celiac disease, Leigh Syndrome, Glycerol Kinase Deficiency, Familial eosinophilia (FE), autosomal recessive spastic ataxia, laryngeal inflammatory disease; Tuberculosis, Chronic cholecystitis, Bronchiectasis, Silicosis and other pneumoconioses.

In various embodiments, the present compositions are used to treat, control or prevent one or more autoimmune diseases or conditions, such as multiple sclerosis, diabetes mellitus, lupus, celiac disease, Crohn's disease, ulcerative colitis, Guillain-Barre syndrome, scleroderms, Goodpasture's syndrome, Wegener's granulomatosis, autoimmune epilepsy, Rasmussen's encephalitis, Primary biliary sclerosis, Sclerosing cholangitis, Autoimmune hepatitis, Addison's disease, Hashimoto's thyroiditis, Fibromyalgia, Menier's syndrome; transplantation rejection (e.g., prevention of allograft rejection) pernicious anemia, rheumatoid arthritis, systemic lupus erythematosus, dermatomyositis, Sjogren's syndrome, lupus erythematosus, multiple sclerosis, myasthenia gravis, Reiter's syndrome, Grave's disease, and other autoimmune diseases.

In various embodiments, the present compositions are used to treat, control or prevent one or more neurologic diseases, including ADHD, AIDS—Neurological Complications, Absence of the Septum Pellucidum, Acquired Epileptiform Aphasia, Acute Disseminated Encephalomyelitis, Adrenoleukodystrophy, Agenesis of the Corpus Callosum, Agnosia, Aicardi Syndrome, Alexander Disease, Alpers' Disease, Alternating Hemiplegia, Alzheimer's Disease, Amyotrophic Lateral Sclerosis, Anencephaly, Aneurysm, Angelman Syndrome, Angiomatosis, Anoxia, Aphasia, Apraxia, Arachnoid Cysts, Arachnoiditis, Arnold-Chiari Malformation, Arteriovenous Malformation, Aspartame, Asperger Syndrome, Ataxia Telangiectasia, Ataxia, Attention Deficit-Hyperactivity Disorder, Autism, Autonomic Dysfunction, Back Pain, Barth Syndrome, Batten Disease, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain Aneurysm, Brain Injury, Brain and Spinal Tumors, Brown-Sequard Syndrome, Bulbospinal Muscular Atrophy, Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Cephalic Disorders, Cerebellar Degeneration, Cerebellar Hypoplasia, Cerebral Aneurysm, Cerebral Arteriosclerosis, Cerebral Atrophy, Cerebral Beriberi, Cerebral Gigantism, Cerebral Hypoxia, Cerebral Palsy, Cerebro-Oculo-Facio-Skeletal Syndrome, Charcot-Marie-Tooth Disorder, Chiari Malformation, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Coma, including Persistent Vegetative State, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Creutzfeldt-Jakob Disease, Cumulative Trauma Disorders, Cushing's Syndrome, Cytomegalic Inclusion Body Disease (CIBD), Cytomegalovirus Infection, Dancing Eyes-Dancing Feet Syndrome, Dandy-Walker Syndrome, Dawson Disease, De Morsier's Syndrome, Dejerine-Klumpke Palsy, Dementia—Multi-Infarct, Dementia—Subcortical, Dementia With Lewy Bodies, Dermatomyositis, Developmental Dyspraxia, Devic's Syndrome, Diabetic Neuropathy, Diffuse Sclerosis, Dravet's Syndrome, Dysautonomia, Dysgraphia, Dyslexia, Dysphagia, Dyspraxia, Dystonias, Early Infantile Epileptic Encephalopathy, Empty Sella Syndrome, Encephalitis Lethargica, Encephalitis and Meningitis, Encephaloceles, Encephalopathy, Encephalotrigeminal Angiomatosis, Epilepsy, Erb's Palsy, Erb-Duchenne and Dejerine-Klumpke Palsies, Fabry's Disease, Fahr's Syndrome, Fainting, Familial Dysautonomia, Familial Hemangioma, Familial Idiopathic Basal Ganglia Calcification, Familial Spastic Paralysis, Febrile Seizures (e.g., GEFS and GEFS plus), Fisher Syndrome, Floppy Infant Syndrome, Friedreich's Ataxia, Gaucher's Disease, Gerstmann's Syndrome, Gerstmann-Straussler-Scheinker Disease, Giant Cell Arteritis, Giant Cell Inclusion Disease, Globoid Cell Leukodystrophy, Glossopharyngeal Neuralgia, Guillain-Barre Syndrome, HTLV-1 Associated Myelopathy, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster Oticus, Herpes Zoster, Hirayama Syndrome, Holoprosencephaly, Huntington's Disease, Hydranencephaly, Hydrocephalus—Normal Pressure, Hydrocephalus, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Phytanic Acid Storage Disease, Infantile Refsum Disease, Infantile Spasms, Inflammatory Myopathy, Intestinal Lipodystrophy, Intracranial Cysts, Intracranial Hypertension, Isaac's Syndrome, Joubert Syndrome, Kearns-Sayre Syndrome, Kennedy's Disease, Kinsbourne syndrome, Kleine-Levin syndrome, Klippel Feil Syndrome, Klippel-Trenaunay Syndrome (KTS), Klüver-Bucy Syndrome, Korsakoffs Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lissencephaly, Locked-In Syndrome, Lou Gehrig's Disease, Lupus—Neurological Sequelae, Lyme Disease—Neurological Complications, Machado-Joseph Disease, Macrencephaly, Megalencephaly, Melkersson-Rosenthal Syndrome, Meningitis, Menkes Disease, Meralgia Paresthetica, Metachromatic Leukodystrophy, Microcephaly, Migraine, Miller Fisher Syndrome, Mini-Strokes, Mitochondrial Myopathies, Mobius Syndrome, Monomelic Amyotrophy, Motor Neuron Diseases, Moyamoya Disease, Mucolipidoses, Mucopolysaccharidoses, Multi-Infarct Dementia, Multifocal Motor Neuropathy, Multiple Sclerosis, Multiple System Atrophy with Orthostatic Hypotension, Multiple System Atrophy, Muscular Dystrophy, Myasthenia—Congenital, Myasthenia Gravis, Myelinoclastic Diffuse Sclerosis, Myoclonic Encephalopathy of Infants, Myoclonus, Myopathy—Congenital, Myopathy—Thyrotoxic, Myopathy, Myotonia Congenita, Myotonia, Narcolepsy, Neuroacanthocytosis, Neurodegeneration with Brain Iron Accumulation, Neurofibromatosis, Neuroleptic Malignant Syndrome, Neurological Complications of AIDS, Neurological Manifestations of Pompe Disease, Neuromyelitis Optica, Neuromyotonia, Neuronal Ceroid Lipofuscinosis, Neuronal Migration Disorders, Neuropathy—Hereditary, Neurosarcoidosis, Neurotoxicity, Nevus Cavernosus, Niemann-Pick Disease, O'Sullivan-McLeod Syndrome, Occipital Neuralgia, Occult Spinal Dysraphism Sequence, Ohtahara Syndrome, Olivopontocerebellar Atrophy, Opsoclonus Myoclonus, Orthostatic Hypotension, Overuse Syndrome, Pain—Chronic, Paraneoplastic Syndromes, Paresthesia, Parkinson's Disease, Parnyotonia Congenita, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Piriformis Syndrome, Pituitary Tumors, Polymyositis, Pompe Disease, Porencephaly, Post-Polio Syndrome, Postherpetic Neuralgia, Postinfectious Encephalomyelitis, Postural Hypotension, Postural Orthostatic Tachycardia Syndrome, Postural Tachycardia Syndrome, Primary Lateral Sclerosis, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Pseudotumor Cerebri, Pyridoxine Dependent and Pyridoxine Responsive Seizure Disorders, Ramsay Hunt Syndrome Type I, Ramsay Hunt Syndrome Type II, Rasmussen's Encephalitis and other autoimmune epilepsies, Reflex Sympathetic Dystrophy Syndrome, Refsum Disease—Infantile, Refsum Disease, Repetitive Motion Disorders, Repetitive Stress Injuries, Restless Legs Syndrome, Retrovirus-Associated Myelopathy, Rett Syndrome, Reye's Syndrome, Riley-Day Syndrome, SUNCT Headache, Sacral Nerve Root Cysts, Saint Vitus Dance, Salivary Gland Disease, Sandhoff Disease, Schilder's Disease, Schizencephaly, Seizure Disorders, Septo-Optic Dysplasia, Severe Myoclonic Epilepsy of Infancy (SMEI), Shaken Baby Syndrome, Shingles, Shy-Drager Syndrome, Sjogren's Syndrome, Sleep Apnea, Sleeping Sickness, Soto's Syndrome, Spasticity, Spina Bifida, Spinal Cord Infarction, Spinal Cord Injury, Spinal Cord Tumors, Spinal Muscular Atrophy, Spinocerebellar Atrophy, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen Disease, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Tuberous Sclerosis, Vascular Erectile Tumor, Vasculitis including Temporal Arteritis, Von Economo's Disease, Von Hippel-Lindau disease (VHL), Von Recklinghausen's Disease, Wallenberg's Syndrome, Werdnig-Hoffman Disease, Wernicke-Korsakoff Syndrome, West Syndrome, Whipple's Disease, Williams Syndrome, Wilson's Disease, X-Linked Spinal and Bulbar Muscular Atrophy, and Zellweger Syndrome.

In various embodiments, the present compositions are used to treat one or more respiratory diseases, such as asthma, chronic obstructive pulmonary disease (COPD), bronchiectasis, allergic rhinitis, sinusitis, pulmonary vasoconstriction, inflammation, allergies, impeded respiration, respiratory distress syndrome, cystic fibrosis, pulmonary hypertension, pulmonary vasoconstriction, emphysema, Hantavirus pulmonary syndrome (HPS), Loeffler's syndrome, Goodpasture's syndrome, Pleurisy, pneumonitis, pulmonary edema, pulmonary fibrosis, Sarcoidosis, complications associated with respiratory syncitial virus infection, and other respiratory diseases.

In various embodiments, the present compositions are used to treat, control or prevent cardiovascular disease, such as a disease or condition affecting the heart and vasculature, including but not limited to, coronary heart disease (CHD), cerebrovascular disease (CVD), aortic stenosis, peripheral vascular disease, atherosclerosis, arteriosclerosis, myocardial infarction (heart attack), cerebrovascular diseases (stroke), transient ischaemic attacks (TIA), angina (stable and unstable), atrial fibrillation, arrhythmia, vavular disease, and/or congestive heart failure.

In various embodiments, the present compositions are used to treat, control or prevent one or more metabolic-related disorders. In various embodiments, the present invention is useful for the treatment, controlling or prevention of diabetes, including Type 1 and Type 2 diabetes and diabetes associated with obesity. The compositions and methods of the present invention are useful for the treatment or prevention of diabetes-related disorders, including without limitation diabetic nephropathy, hyperglycemia, impaired glucose tolerance, insulin resistance, obesity, lipid disorders, dyslipidemia, hyperlipidemia, hypertriglyceridemia, hypercholesterolemia, low HDL levels, high LDL levels, atherosclerosis and its sequelae, vascular restenosis, irritable bowel syndrome, inflammatory bowel disease, including Crohn's disease and ulcerative colitis, other inflammatory conditions, pancreatitis, abdominal obesity, neurodegenerative disease, retinopathy, neoplastic conditions, adipose cell tumors, adipose cell carcinomas, such as liposarcoma, prostate cancer and other cancers, including gastric, breast, bladder and colon cancers, angiogenesis, Alzheimer's disease, psoriasis, high blood pressure, Metabolic Syndrome (e.g. a person has three or more of the following disorders: abdominal obesity, hypertriglyceridemia, low HDL cholesterol, high blood pressure, and high fasting plasma glucose), ovarian hyperandrogenism (polycystic ovary syndrome), and other disorders where insulin resistance is a component, such as sleep apnea. The compositions and methods of the present invention are useful for the treatment, control, or prevention of obesity, including genetic or environmental, and obesity-related disorders. The obesity-related disorders herein are associated with, caused by, or result from obesity. Examples of obesity-related disorders include obesity, diabetes, overeating, binge eating, and bulimia, hypertension, elevated plasma insulin concentrations and insulin resistance, dyslipidemia, hyperlipidemia, endometrial, breast, prostate, kidney and colon cancer, osteoarthritis, obstructive sleep apnea, gallstones, heart disease, abnormal heart rhythms and arrythmias, myocardial infarction, congestive heart failure, coronary heart disease, sudden death, stroke, polycystic ovary disease, craniopharyngioma, Prader-Willi Syndrome, Frohlich's syndrome, GH-deficient subjects, normal variant short stature, Turner's syndrome, and other pathological conditions showing reduced metabolic activity or a decrease in resting energy expenditure as a percentage of total fat-free mass, e.g, children with acute lymphoblastic leukemia. Further examples of obesity-related disorders are Metabolic Syndrome, insulin resistance syndrome, reproductive hormone abnormalities, sexual and reproductive dysfunction, such as impaired fertility, infertility, hypogonadism in males and hirsutism in females, fetal defects associated with maternal obesity, gastrointestinal motility disorders, such as obesity-related gastro-esophageal reflux, respiratory disorders, such as obesity-hypoventilation syndrome (Pickwickian syndrome), breathlessness, cardiovascular disorders, inflammation, such as systemic inflammation of the vasculature, arteriosclerosis, hypercholesterolemia, lower back pain, gallbladder disease, hyperuricemia, gout, and kidney cancer, and increased anesthetic risk. The compositions and methods of the present invention are also useful to treat Alzheimer's disease.

Nucleic acids, including liposomal formulations containing nucleic acids, when delivered in vivo, can accumulate in the liver and/or spleen. It has now been discovered that nucleic acids encoding proteins can modulate protein expression in the liver and spleen, and that nucleic acids used in this manner can constitute potent therapeutics for the treatment of liver and spleen diseases. Certain embodiments are therefore directed to a method for treating liver and/or spleen disease by delivering to a patient a nucleic acid encoding a protein of interest. Other embodiments are directed to a therapeutic composition comprising a nucleic acid encoding a protein of interest, for the treatment of liver and/or spleen disease. Diseases and conditions of the liver and/or spleen that can be treated include, but are not limited to: hepatitis, alcohol-induced liver disease, drug-induced liver disease, Epstein Barr virus infection, adenovirus infection, cytomegalovirus infection, toxoplasmosis, Rocky Mountain spotted fever, non-alcoholic fatty liver disease, hemochromatosis, Wilson's Disease, Gilbert's Disease, and cancer of the liver and/or spleen.

In some embodiments, the present compositions and methods relate to the treatment of type 1 diabetes, heart disease, including ischemic and dilated cardiomyopathy, macular degeneration, Parkinson's disease, cystic fibrosis, sickle-cell anemia, thalassemia, Fanconi anemia, severe combined immunodeficiency, hereditary sensory neuropathy, xeroderma pigmentosum, Huntington's disease, muscular dystrophy, amyotrophic lateral sclerosis, Alzheimer's disease, cancer, and infectious diseases including hepatitis and HIV/AIDS.

Further, in some embodiments, the present methods and compositions find use in targeting any of the proteins or in treatment of any of the diseases or disorders of Table 2B. In various embodiments, the present invention contemplates the targeting of the full-length and/or truncated forms of any of the proteins disclosed in Table 2B. In various embodiments, the present invention contemplates the targeting of the precursor forms and/or mature forms and/or isoforms of any of the proteins disclosed in Table 2B.

In various embodiments, the present invention contemplates the targeting of a protein having about 60% (e.g. about 60%, or about 61%, or about 62%, or about 63%, or about 64%, or about 65%, or about 66%, or about 67%, or about 68%, or about 69%, or about 70%, or about 71%, or about 72%, or about 73%, or about 74%, or about 75%, or about 76%, or about 77%, or about 78%, or about 79%, or about 80%, or about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99%) sequence identity with any of the protein sequences disclosed herein (e.g. in Table 2B).

In various embodiments, the present invention contemplates the targeting of a protein comprising an amino acid sequence having one or more amino acid mutations relative to any of the protein sequences described herein (e.g. in Table 2B). For example, the present invention contemplates the targeting of a protein comprising an amino acid sequence having 1, or 2, or 3, or 4, or 5, or 6, or 7, or 8, or 9, or 10, or 11, or 12 amino acid mutations relative to any of the protein sequences described herein (e.g. in Table 2B). In some embodiments, the one or more amino acid mutations may be independently selected from substitutions, insertions, deletions, and truncations.

In some embodiments, the amino acid mutations are amino acid substitutions, and may include conservative and/or non-conservative substitutions.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups: (1) hydrophobic: Met, Ala, Val, Leu, Ile; (2) neutral hydrophilic: Cys, Ser, Thr; Asn, Gln; (3) acidic: Asp, Glu; (4) basic: His, Lys, Arg; (5) residues that influence chain orientation: Gly, Pro; and (6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices.

As used herein, "non-conservative substitutions" are defined as exchanges of an amino acid by another amino acid listed in a different group of the six standard amino acid groups (1) to (6) shown above.

In various embodiments, the substitutions may also include non-classical amino acids (e.g. selenocysteine, pyrrolysine, N-formylmethionine β-alanine, GABA and δ-Aminolevulinic acid, 4-aminobenzoic acid (PABA), D-isomers of the common amino acids, 2,4-diaminobutyric acid, α-amino isobutyric acid, 4-aminobutyric acid, Abu, 2-amino butyric acid, γ-Abu, ε-Ahx, 6-amino hexanoic acid, Aib, 2-amino isobutyric acid, 3-amino propionic acid, ornithine, norleucine, norvaline, hydroxyproline, sarcosme, citrulline, homocitrulline, cysteic acid, t-butylglycine, t-butylalanine, phenylglycine, cyclohexylalanine, β-alanine, fluoro-amino acids, designer amino acids such as β methyl amino acids, C α-methyl amino acids, N α-methyl amino acids, and amino acid analogs in general).

In Table 2B, all Illustrative Identifiers (e.g. Gene Seq nos. and references are hereby incorporated by reference in their entireties).

TABLE 2B

Illustrative Proteins, Illustrative Peptides, and Illustrative Indications

| Protein/Peptide Illustrative Identifier Reference | Description/Illustrative Indication(s) |
|---|---|
| Parathyroid hormone P01270\|PTHY_HUMAN Parathyroid hormone (SEQ ID NO: 508) | PTH is secreted by the chief cells of the parathyroid glands. PTH plays an important role in the regulation of serum calcium, serum phosphate, and vitamin D synthesis. |
| BMP-1 GeneSeq Accession P80618 WO8800205 P13497/BMP1_HUMAN Bone morphogenetic protein 1 (isoform BMP1-3) (SEQ ID NO: 169) P13497-2\|BMP1_HUMAN Isoform BMP1-1 of Bone morphogenetic protein 1 (isoform BMP1-1) (SEQ ID NO: 509) P13497-3\|BMP1_HUMAN Isoform BMP1-4 of Bone morphogenetic protein 1 (isoform BMP1-4) (SEQ ID NO: 510) P13497-4\|BMP1_HUMAN Isoform BMP1-5 of Bone morphogenetic protein 1 (isoform BMP1-5) (SEQ ID NO: 511) | BMP1 belongs to the transforming growth factor-beta (TGFB) super- family. Bone morphogenic proteins induce cartilage and bone formation, play important role in nephrogesis, and play an important role in the development of many organs, including lung, heart, teeth, gut, skin, and particularly the kidney. BMP-1 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |

TABLE 2B-continued

Illustrative Proteins, Illustrative Peptides, and Illustrative Indications

| Protein/Peptide Illustrative Identifier Reference | Description/Illustrative Indication(s) |
|---|---|
| P13497-5\|BMP1_HUMAN Isoform BMP1-6 of Bone morphogenetic protein 1 (isoform BMP1-6) (SEQ ID NO: 512) | |
| P13497-6\|BMP1_HUMAN Isoform BMP1-7 of Bone morphogenetic protein 1 (isoform BMP1-7) (SEQ ID NO: 513) | |
| BMP-2 GeneSeq Accession P80619 WO8800205 P12643/BMP2_HUMAN Bone morphogenetic protein 2 (SEQ ID NO: 170) | BMP-2 belongs to the transforming growth factor-beta (TGFB) superfamily. Bone morphogenic protein induces bone formation. BMP-2 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes. Infarction recovery. Bone repair. Osteoporosis. |
| BMP-3 P12645\|BMP3_HUMAN Bone morphogenetic protein 3 (SEQ ID NO: 514) | BMP-3 belongs to the transforming growth factor-beta (TGFB) superfamily. Bone morphogenic protein induces bone formation. BMP-3 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| BMP-2B GeneSeq Accession W24850 U.S. Pat. No. 5,631,142 P12644/BMP4_HUMAN Bone morphogenetic protein 4 (SEQ ID NO: 171) | BMP-2b belongs to the transforming growth factor-beta (TGFB) superfamily. Bone morphogenic protein induces bone formation. BMP-2b activity can be determined using the following assays known in the art: Nat Genet. 2001 January; 27(1): 84-8; Eur J Biochem 1996 Apr. 1; 237(1): 295-302; I Biol Cbcre, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| BMP-4 GeneSeq Accession B02796 WO0020591 P12644/BMP4_HUMAN Bone morphogenetic protein 4 (SEQ ID NO: 172) | BMP-4 belongs to the transforming growth factor-beta (TGFB) superfamily. Bone morphogenic protein induces bone formation. BMP-4 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| BMP-5 GeneSeq Accession B02797 WO0020591 P22003/BMP5_HUMAN Bone morphogenetic protein 5 (isoform 1) (SEQ ID NO: 173) | BMP-5 belongs to the transforming growth factor-beta (TGFB) superfamily. Bone morphogenic protein induces bone formation. BMP-5 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| P22003-2\|BMP5_HUMAN Isoform 2 of Bone morphogenetic protein 5 (isoform 2) (SEQ ID NO: 515) | |
| BMP-6 GeneSeq Accession R32904 U.S. Pat. No. 5,187,076 P22004/BMP6_HUMAN Bone morphogenetic protein 6 (SEQ ID NO: 174) | BMP-6 belongs to the transforming growth factor-beta (TGFB) superfamily. Bone morphogenic protein induces bone formation. BMP-6 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes. Hemochromatosis. |
| Osteogenic Protein-1; OP-1; BMP-7 GeneSeq Accession W34783 WO973462 P18075/BMP7_HUMAN Bone morphogenetic protein 7 (SEQ ID NO: 175) | OP-1 belongs to the transforming growth factor-beta (TGFB) superfamily. Bone morphogenic protein induces bone formation. OP-1 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| BMP7 Variant A (SEQ ID NO: 579) | OP-1 belongs to the transforming growth factor-beta (TGFB) superfamily. Bone morphogenic protein induces bone formation. OP-1 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |

TABLE 2B-continued

Illustrative Proteins, Illustrative Peptides, and Illustrative Indications

| Protein/Peptide Illustrative Identifier Reference | Description/Illustrative Indication(s) |
| --- | --- |
| BMP7 Variant B (SEQ ID NO: 580) | OP-1 belongs to the transforming growth factor-beta (TGFB) superfamily. Bone morphogenic protein induces bone formation. OP-1 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| BMP7 Variant C (SEQ ID NO: 581) | OP-1 belongs to the transforming growth factor-beta (TGFB) superfamily. Bone morphogenic protein induces bone formation. OP-1 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| Osteogenic Protein-2 GeneSeq Accession R57973 WO9406399 P34820/BMP8B_HUMAN Bone morphogenetic protein 8B (SEQ ID NO: 176) | OP-2 belongs to the transforming growth factor-beta (TGFB) superfamily. Bone morphogenic protein induces bone formation. OP-2 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 0, 1580-1594. Induction of Cartilage, Tissue and Bone Growth, and Diabetes |
| GDF-1 GeneSeq Accession R60961 WO9406449 P27539/GDF1_HUMAN Embryonic growth/differentiation factor 1 (SEQ ID NO: 177) | Members of the TGF-beta family of proteins initiate cell signaling by binding to heteromeric receptor complexes of type I (TbetaRI) and type II (TbetaRII) serine/threonine kinase receptors (reviewed by Massague, J. et al. (1994) Trends Cell Biol. 4: 172 178; Miyazono, K. et al., (1994) Adv. Immunol. 55: 181-220). Activation of this heteromeric receptor complex occurs when TGF-beta binds to TbetaRII, which then recruits and phosphorylates TbetaRI. Activated TbetaRI then propagates the signal to downstream targets (Chen, F. and Weinberg, R. A. (1995) PNA892: 1565-1569; Wrana, J. L. et al. (1994) Nature 370: 341 347). The effect of GDF-1 on signaling can be assayed by treating Primary BAECs transferred with a construct called p3TP-Lux, containing a TGF-beta responsive promoter fused to a reporter gene, and measuring luciferase gene expression (Wrana et al., 1994, Nature 370: 341-347). Developmental disorders, Induction of Cartilage, Tissue and Bone Growth, and Diabetes |
| BMP-9 GeneSeq Accession R86903 WO9533830 Q9UK05/GDF2_HUMAN Growth/differentiation factor 2 (SEQ ID NO: 178) | BMP-9 belongs to the transforming growth factor-beta (TGFB) superfamily. Bone morphogenic protein induces bone formation. BMP-9 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| BMP-10 GeneSeq Accession R66202 WO9426893 Q95393/BMP10_HUMAN Bone morphogenetic protein 10 (SEQ ID NO: 179) | BMP-10 belongs to the transforming growth factor-beta (TGFB) superfamily. Bone morphogenic protein induces bone formation. BMP-10 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| BMP-12 GeneSeq Accession R78734 WO9516035 Q7Z4P5/GDF7_HUMAN Growth/differentiation factor 7 (SEQ ID NO: 180) | BMP-12 belongs to the transforming growth factor-beta (TGFB) superfamily. Bone morphogenic protein induces bone formation. BMP-12 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| BMP-15 GeneSeq Accession W11261 W09636710 O95972/BMP15_HUMAN Bone morphogenetic protein 15 (SEQ ID NO: 181) | BMP-15 belongs to the transforming growth factor-beta (TGFB) superfamily. Bone morphogenic protein induces bone formation. BMP-15 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| BMP-17 GeneSeq Accession Y17870 WO9929718 SEQ ID NO: 2 from U.S. Pat. No. 7,151,086 (SEQ ID NO: 182) | BMP-17 belongs to the transforming growth factor-beta (TGFB) superfamily. Bone morphogenic protein induces bone formation. BMP-17 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |
| BMP-18 GeneSeq Accession Y17871 WO9929718 SEQ ID NO: 4 from U.S. Pat. No. 7,151,086 (SEQ ID NO: 183) | BMP-18 belongs to the transforming growth factor-beta (TGFB) superfamily. Bone morphogenic protein induces bone formation. BMP-18 activity can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Induction of Cartilage, Tissue and Bone Growth, and Diabetes |

TABLE 2B-continued

Illustrative Proteins, Illustrative Peptides, and Illustrative Indications

| Protein/Peptide Illustrative Identifier Reference | Description/Illustrative Indication(s) |
|---|---|
| Inhibin alpha GeneSeq Accession B02806 WO0020591 P05111/INHA_HUMAN Inhibin alpha chain (SEQ ID NO: 184) | The inhibin beta A subunit joins the alpha subunit to form a pituitary FSH secretion inhibitor. Inhibin has been shown to regulate gonadal stromal cell proliferation negatively and to have tumor-suppressor activity. In addition, serum levels of inhibin have been shown to reflect the size of granulosa-cell tumors and can therefore be used as a marker for primary as well as recurrent disease. Tumor suppressor activity of inhibin can be determined using assays known in the art: Matzuk et al., Nature 1992 Nov. 26: 360 (6402); 313-9. Tumor suppression. |
| Inhibin beta GeneSeq Accession H02808 WO0020591 P08476/INHBA_HUMAN Inhibin beta A chain (SEQ ID NO: 185) P09529/INHBB_HUMAN Inhibin beta B chain (SEQ ID NO: 186) | The inhibin beta A subunit joins the alpha subunit to form a pituitary FSH secretion inhibitor. Inhibin has been shown to regulate gonadal stromal cell proliferation negatively and to have tumour-suppressor activity. In addition, serum levels of inhibin have been shown to reflect the size of granulosa-cell tumors and can therefore be used as a marker for primary as well as recurrent disease. Tumor suppressor activity of inhibin can be determined using assays known in the art: Matzuk et al., Nature 1992 Nov. 26: 360 (6402); 313-9. Tumor suppression. |
| Cerberus Protein GeneSeq Accession W86032 WO9849296 O95813/CER1_HUMAN Cerberus (SEQ ID NO: 187) | Cerebus is believed to be involved in the inhibition of BMP activity BMP activity, in the presence of the antagonist Cerebus, can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. BMP Antagonist useful for Osteosarcoma, abnormal bone growth. |
| Soluble BMP Receptor Kinase Protein-3 GeneSeq Accession R95227 WO9614579 Q13873/BMPR2_HUMAN Bone morphogenetic protein receptor type-2 (SEQ ID NO: 188) | Soluble BMP receptor kinase protein-3 is involved in the binding of BMPs. Soluble BMP receptor kinase protein-3 is useful as an antagonist for the inhibition of BMP activity. BMP activity, in the presence of the soluble antagonist BMP receptor kinase protein-3, can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. BMP Antagonist useful for Osteosarcoma, abnormal bone growth. |
| BMP Processing Enzyme Furin GeneSeq Accession W36099 WO9741250 P09958/FURIN_HUMAN Furin (SEQ ID NO: 189) | BMPs belong to the transforming growth factor-beta (TGFB) superfamily. Bone morphogenic protein induces bone formation. BMP activity, in the presence of the Furin, can be determined using the following assays known in the art: Nat Genet. 2001 January; 27(1): 84-8; Eur J Biochem 1996 Apr. 1; 237(1): 295-302; J Biol Chem, Vol. 274, Issue 16, 10897-10902, Apr. 16, 1999; and Hogan, B. L. M. (1996) Genes Dev. 10, 1580-1594. Bone formation or Regeneration Abnormalities |
| TGF-beta 1 GeneSeq Accession R29657 WO9216228 P01137/TGFB1_HUMAN Transforming growth factor beta-1 (SEQ ID NO: 190) | Members of the TGF-beta family of proteins initiate cell signaling by binding to heteromeric receptor complexes of type I (TbetaRI) and type II (TbetaRII) serine/threonine kinase receptors (reviewed by Massague, J. et al. (1994) Trends Cell Biol. 4: 172 178; Miyazono, K. et al. (1994) Adv. Immunol. 55: 181-220). Activation of this heteromeric receptor complex occurs when TGF-beta. binds to TbetaRII, which then recruits and phosphorylates TbetaRI. Activated TbetaRI then propagates the signal to downstream targets (Chen, F. and Weinberg. R. A. (1995) PNA892: 1565-1569; Wrana, J. L. et al. (1994) Nature 370: 341. The effect of TGF betas on signaling can be assayed by treating Primary BAECs transfected with a construct called p3TP-Lux, containing a TGF- beta responsive promoter fused to a reporter gene, and measuring luciferase gene expression (Wrana et al., 1994, Nature 370: 341-347). Useful for treating cancer and to promote wound healing. |
| TGF-beta 2 GeneSeq Accession R39659 EP542679 P61812/TGFB2_HUMAN Transforming growth factor beta-2 (SEQ ID NO: 191) | Members of the TGF-beta family of proteins initiate cell signaling by binding to heteromeric receptor complexes of type I (TbetaRI) and type II (TbetaRII) serine/threonine kinase receptors (reviewed by Massague, J. et al. (1994) Trends Cell Biol. 4: 172 178; Miyazono, K. et al. (1994) Adv. Immunol. 55: 181-220). Activation of this heteromeric receptor complex occurs when TGF-beta. binds to TbetaRII, which then recruits and phosphorylates TbetaRI. Activated TbetaRI then propagates the signal to downstream targets (Chen, F. and Weinberg. R. A. (1995) PNA892: 1565-1569; Wrana, J. L. et al. (1994) Nature 370: 341. The effect of TGF betas on signaling can be assayed by treating Primary BAECs transfected with a construct called p3TP-Lux, containing a TGF- beta responsive promoter fused to a reporter gene, and measuring luciferase gene expression (Wrana et al., 1994, Nature 370: 341-347). Useful for treating cancer and to promote wound healing. |
| ZTGF-beta 9 GeneSeq Accession Y70654 WO0015798 SEQ ID NO: 2 of WO0015798 (SEQ ID NO: 192) | Members of the TGF-beta family of proteins initiate cell signaling by binding to heteromeric receptor complexes of type I (TbetaRI) and type II (TbetaRII) serine/threonine kinase receptors (reviewed by Massague, J. et al. (1994) Trends Cell Biol. 4: 172 178; Miyazono, K. et al. (1994) Adv. Immunol. 55: 181-220). Activation of this heteromeric receptor complex occurs when TGF-beta. binds to TbetaRII, which then recruits and phosphorylates TbetaRI. Activated TbetaRI then propagates the signal to downstream targets (Chen, F. and Weinberg. R. A. (1995) PNA892: 1565-1569; Wrana, J. L. et al. (1994) Nature 370: 341. The effect of TGF betas on signaling can be assayed by treating Primary BAECs transfected with a construct called p3TP-Lux, containing a TGF- beta responsive promoter fused to a reporter gene, and measuring luciferase gene expression (Wrana et al., 1994, Nature 370: 341-347). Useful for treating cancer and to promote wound healing. |

TABLE 2B-continued

Illustrative Proteins, Illustrative Peptides, and Illustrative Indications

| Protein/Peptide Illustrative Identifier Reference | Description/Illustrative Indication(s) |
|---|---|
| Anti-TGF beta family antibodies GB2305921 | Members of the TGF-beta family of proteins initiate cell signaling by binding to heteromeric receptor complexes of type I (TbetaRI) and type II (TbetaRII) serine/threonine kinase receptors (reviewed by Massague, J. et al. (1994) Trends Cell Biol. 4: 172 178; Miyazono, K. et al. (1994) Adv. Immunol. 55: 181-220). Activation of this heteromeric receptor complex occurs when TGF-beta. binds to TbetaRII, which then recruits and phosphorylates TbetaRI. Activated TbetaRI then propagates the signal to downstream targets (Chen, F. and Weinberg. R. A. (1995) PNA892: 1565-1569; Wrana, J. L. et al. (1994) Nature 370: 341. The effect of TGF betas on signaling in the presence of an anti-TGF beta antibody, can be assayed by treating Primary BAECs transfected with a construct called p3TP-Lux, containing a TGF-beta responsive promoter fused to a reporter gene, and measuring luciferase gene expression (Wrana et al., 1994, Nature 370: 341-347). Useful for control of fibrosis, immune, and inflammatory disease. |
| Latent TGF beta binding protein II GeneSeq Accession Y70552 WO0012551 Q14767/LTBP2__HUMAN Latent-transforming growth factor beta-binding protein 2 (SEQ ID NO: 193) | Members of the TGF-beta family of proteins initiate cell signaling by binding to heteromeric receptor complexes of type I (TbetaRI) and type II (TbetaRII) serine/threonine kinase receptors (reviewed by Massague, J. et al. (1994) Trends Cell Biol. 4: 172 178; Miyazono, K. et al. (1994) Adv. Immunol. 55: 181-220). Activation of this heteromeric receptor complex occurs when TGF-beta. binds to TbetaRII, which then recruits and phosphorylates TbetaRI. Activated TbetaRI then propagates the signal to downstream targets (Chen, F. and Weinberg. R. A. (1995) PNA892: 1565-1569; Wrana, J. L. et al. (1994) Nature 370: 341. The effect of TGF betas on signaling in the presence of a TGF beta binding protein, can be assayed by treating Primary BAECs transfected with a construct called p3TP-Lux, containing a TGF-beta responsivepromoter fused to a reporter gene, and measuring luciferase gene expression (Wrana et al., 1994, Nature 370: 341-347). Useful for inhibiting tissue or tumor growth. |
| MP52 GeneSeq Accession W36100 WO9741250 P43026/GDF5__HUMAN Growth/differentiation factor 5 (SEQ ID NO: 194) | Members of the TGF-beta family of proteins initiate cell signaling by binding to heteromeric receptor complexes of type I (TbetaRI) and type II (TbetaRII) serine/threonine kinase receptors (reviewed by Massague, J. et al. (1994) Trends Cell Biol. 4: 172 178; Miyazono, K. et al. (1994) Adv. Immunol. 55: 181-220). Activation of this heteromeric receptor complex occurs when TGF-beta. binds to TbetaRII, which then recruits and phosphorylates TbetaRI. Activated TbetaRI then propagates the signal to downstream targets (Chen, F. and Weinberg. R. A. (1995) PNA892: 1565-1569; Wrana, J. L. et al. (1994) Nature 370: 341. The effect of TGF betas on signaling can be assayed by treating Primary BAECs transfected with a construct called p3TP-Lux, containing a TGF- beta responsive promoter fused to a reporter gene, and measuring luciferase gene expression (Wrana et al., 1994, Nature 370: 341-347). Bone formation or Regeneration Abnormalities |
| b57 Protein GeneSeq Accession W69293 WO9837195 SEQ ID NO: 2 of WO9837195 (SEQ ID NO: 195) | BMPs are involved in the induction of bone formation. Specific antagonists are useful is preventing this activity from occurring. BMP activity, in the presence of b57 protein, can be determined using the following assays known in the art: Nat Genet. 2001 January; 27(1): 84-8; Eur J Biochem 1996 Apr. 1; 237(1): 295-302; J Biol Chem, Vol. 274, Issue 16, 1089-10902, Apr. 16, 1999; and Hogan, B. L. M. (1996) Genes Deve. 10, 1580-1594. BMP Antagonist useful for Osteosarcoma, abnormal bone growth. |
| Resistin GeneSeq Accession W69293 WO0064920 Q9HD89/RETN__HUMAN Resistin (isoform 1) (SEQ ID NO: 196) | This gene belongs to the family defined by mouse FIZZI and FIZZ3/Resistin genes. The characteristic feature of this family is the C-terminal stretch of 10 cys residues with identical spacing. The mouse homolog of this protein is secreted by adipocytes, may be the hormone potentially linking obesity to type II diabetes. Ability of resistin to influence type II diabetes can be determined using assays known in the art: Pontoglio et al., J Clin Invest 1998 May 15; 101(10): 2215-22. Type II diabetes and Syndrome X. |
| Galectin-4 GeneSeq Accession W11841 WO9703190 P56470/LEG4__HUMAN Galectin-4 (SEQ ID NO: 197) | Galectins are a family of carbohydrate-binding proteins characterized by an affinity for beta- galactoside containing glycoconjugates. Ability of Galectin-4 polypeptides to bind lactose can be determined using assays known in the art: Wada, et al., J Biol Chem 1997 Feb. 28; 272(9): 6078-86. Lactose intolerance. |
| APM-I; ACRP- 30; Famoxin GeneSeq Accession Y71035 W00026363 Q15848/ADIPO__HUMAN Adiponectin (SEQ ID NO: 198) | ACPR30 gene is exclusively expressed in adipose tissue. ACRP30 is thought to increase fatty acid oxidation by muscle tissue. Ability of ACRP30 polypeptides to influence obesity and fat oxidation can be determined using assays known in the art: Fruebis et al., Proc Nat'l Acad Sci USA 2001 Feb. 13; 98(4): 2005-10. Obesity, Metabolic disorders, Lipid Metabolism; Hormone Secretion. |
| ACRP-30 Homologue; Complement Component C1q C GeneSeq Accession B30234 WO0063376 P02747/C1QC__HUMAN Complement C1q subcomponent subunit C (SEQ ID NO: 199) | ACRP30 gene is exclusively expressed in adipose tissue. ACRP30 is thought to increase fatty acid oxidation by muscle tissue. Ability of ACRP30 homologue polypeptides to influence obesity and fat oxidation can be determined using assays known in the art: Fruebis et al., Proc Nat'l Acad Sci USA 2001 Feb. 13; 98(4): 2005-10. Obesity, Metabolic disorders, Lipid Metabolism; Hormone Secretion. |

TABLE 2B-continued

Illustrative Proteins, Illustrative Peptides, and Illustrative Indications

| Protein/Peptide Illustrative Identifier Reference | Description/Illustrative Indication(s) |
|---|---|
| Calpain-10a GeneSeq Accession Y79567 WO0023603 Q9HC96/CAN10_HUMAN Calpain-10 (Isoform A) (SEQ ID NO: 200) | Calpain is believed to play a role in insulin secretion and insulin activity, and therefore may be useful in the treatment of type II diabetes. Ability of Calpain-10 to influence type II diabetes can be determined using assays known in the art: Pontoglio et al., J Clin Invest 1998 May 15; 101(10): 2215-22. Diabetes mellitus; Regulation of Insulin secretory response; Insulin mediated glucose transport disorders. |
| Calpain-10b GeneSeq Accession Y79568 WO0023603 Q9HC96-2/CAN10_HUMAN Isoform B of Calpain-10 (SEQ ID NO: 201) | Calpain is believed to play a role in insulin secretion and insulin activity, and therefore may be useful in the treatment of type II diabetes. Ability of Calpain-10 to influence type II diabetes can be determined using assays known in the art: Pontoglio et al., J Clin Invest 1998 May 15; 101(10): 2215-22. Diabetes mellitus; Regulation of Insulin secretory response; Insulin mediated glucose transport disorders. |
| Calpain-10c GeneSeq Accession Y79569 WO0023603 Q9HC96-3/CAN10_HUMAN Isoform C of Calpain-10 (SEQ ID NO: 202) | Calpain is believed to play a role in insulin secretion and insulin activity, and therefore may be useful in the treatment of type II diabetes. Ability of Calpain-10 to influence type II diabetes can be determined using assays known in the art: Pontoglio et al., J Clin Invest 1998 May 15; 101(10): 2215-22. Diabetes mellitus; Regulation of Insulin secretory response; Insulin mediated glucose transport disorders. |
| PDGF-D GeneSeq Accession Y71130 WO0027879 Q9GZP0/PDGFD_HUMAN Platelet-derived growth factor D (isoform 1) (SEQ ID NO: 203) | Vascular Endothelial Growth Factor. Proliferation assay using NR6R-3T3 cells (Rizzino 1988 Cancer Res. 48: 4266). Wound Healing; Atherosclermis. |
| FasL GeneSeq Accession Y28594 WO9936079 P48023/TNFL6_HUMAN Tumor necrosis factor ligand superfamily member 6 (isoform 1) (SEQ ID NO: 204) | Activities associated with apoptosis and immune system functions. Activity can be determined using Apoptosis assays known in the art: Walczak et al. (1996) EMBOJ 16: 5386-5397. Apoptosis-related disorders; Auto- immune disorders; Graft v-Host disorders. |
| Chondro modulin-like protein GeneSeq Accession Y71262 WO0029579 SEQ ID NO: 2 from WO0029579 (SEQ ID NO: 370) | Chondromodulin proteins are cartilage proteins thought to confer resistance to anglogeneis, and thus are useful as antiangiogenic agents that may have utility in combating cancer. Ability of Chondromodulin-like protein to inhibit vascularization can be determined using assays known in the art: Hirakie et al., J Biol Chem 1997 Dec. 19; 272(51): 32419-26. Antianglogenic agent; Osteoblast proliferation stimulator; prevents vascularization of cartilage tissue; Useful to treat cancer. |
| Patched GeneSeq Accession W72969 U.S. Pat. No. 5,837,538 Q13635/PTC1_HUMAN Protein patched homolog 1 (isoform L) (SEQ ID NO: 205) | Patched is a tumour-suppressor receptor for Sonic hedgehog (shh), which is a protein that controls developmental patterning and growth. Ability of soluble Patched to bind to and inhibit the activities of shh can be determined using assays known in the art: Stone et al., Nature 1996 Nov. 14; 384(6605): 129-34. Receptor for Hedgehog cellular proliferation signaling molecule. This receptor is useful as a means of preventing cellular proliferation via the shh signaling path- way, thus useful for cancers. |
| Patched-2 GeneSeq Accession Y43261 WO9953058 Q9Y6C5/PTC2_HUMAN Protein patched homolog 2 (isoform 1) (SEQ ID NO: 206) | Patched is a tumour-suppressor receptor for Sonic hedgehog (shh), which is a protein that controls developmental patterning and growth. Ability of soluble Patched to bind to and inhibit the activities of shh can be determined using assays known in the art: Stone et al., Nature 1996 Nov. 14; 384(6605): 129-34. Receptor for Hedgehog cellular proliferation signaling molecule. This receptor is useful as a means of preventing cellular proliferation via the shh signaling path- way, thus useful for cancers. |
| Maspin; Protease Inhibitor 5 GeneSeq Accession R50938 WO9405804 P36952/SPB5_HUMAN Serpin B5 (isoform 1) (SEQ ID NO: 207) | Maspin is a member of the serpin family of serine protease inhibitors that is thought to suppress tumor metastasis. The inhibitory effects of Maspin and other protease inhibitors can be assayed using methods known in the art such as a labeled protease substrate, for example, Universal Protease Substrate (casein, resorufin-labeled): Roche Molecular Biochemicals, Cat. No. 1080733. Tumor suppressor which is down-regulated in breast cancers. The maspin protein has tumour suppressing and invasion sup- pressing activity. |
| Endostatin GeneSeq Accession B28399 WO0064946 P39060/COIA1_HUMAN Collagen alpha-1(XVIII) chain (isoform 1) (SEQ ID NO: 208) | Endostatin is believed to inhibit effects of capillary endothelial cell proliferation. The inhibitory effects of endostatin can be assayed using assays disclosed by Cao et al. (1996) J. Biol. Chem. 271 29461-29467. antiangiogenic activity. Useful in the prevention and/or treatment of cancers. |

TABLE 2B-continued

*Illustrative Proteins, Illustrative Peptides, and Illustrative Indications*

| Protein/Peptide Illustrative Identifier Reference | Description/Illustrative Indication(s) |
|---|---|
| aFGF; FGF-1 GeneSeq Accession P94037 EP298723 P05230/FGF1_HUMAN Fibroblast growth factor 1 (isoform 1) (SEQ ID NO: 209) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Antagonists may be useful as anti-cancer agents. Diabetes, Metabolic Disease, Obesity. |
| bFGF; FGF-2 GeneSeq Accession R06685 FR2642086 P09038/FGF2_HUMAN Fibroblast growth factor 2 (isoform 1) (SEQ ID NO: 210) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Antagonists may be useful as anti-cancer agents. |
| FGF-3; INT-2 GeneSeq Accession R07824 WO9503831 P11487/FGF3_HUMAN Fibroblast growth factor 3 (SEQ ID NO: 211) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Antagonists may be useful as anti-cancer agents. |
| FGF-4; HST-1; HBGF-4 GeneSeq Accession R07825 WO9503831 P08620/FGF4_HUMAN Fibroblast growth factor 4 (isoform 1) (SEQ ID NO: 212) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Antagonists may be useful as anti-cancer agents. |
| FGF-5 GeneSeq Accession W22600 WO9730155 P12034/FGF5_HUMAN Fibroblast growth factor 5 (isoform long) (SEQ ID NO: 213) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Antagonists may be useful as anti-cancer agents. |
| FGF-6; Heparin binding secreted transforming factor-2 GeneSeq Accession R58555 EP613946 P10767/FGF6_HUMAN Fibroblast growth factor 6 (SEQ ID NO: 214) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Antagonists may be useful as anti-cancer agents. |
| FGF-8 GeneSeq Accession R80783 WO9524928 P55075/FGF8_HUMAN Fibroblast growth factor 8 (isoform 8E) (SEQ ID NO: 215) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Antagonists may be useful as anti-cancer agents. |
| FGF-9; Gila activating factor GeneSeq Accession R70822 WO9503831 P31371/FGF9_HUMAN Fibroblast growth factor 9 (SEQ ID NO: 216) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Hair growth. Antagonists may be useful as anti-cancer agents. |
| FGF-12; Fibroblast growth factor homologous factor-1 GeneSeq Accession W06309 WO9635708 P61328/FGF12_HUMAN Fibroblast growth factor 12 (isoform 1) (SEQ ID NO: 217) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Antagonists may be useful as anti-cancer agents. |
| FGF-19 GeneSeq Accession Y08582 WO9927100 O95750/FGF19_HUMAN Fibroblast growth factor 19 (SEQ ID NO: 218) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Chronic liver disease. Primary biliary cirrhosis. Bile acid-induced liver damage. Antagonists may be useful as anti-cancer agents. |

TABLE 2B-continued

Illustrative Proteins, Illustrative Peptides, and Illustrative Indications

| Protein/Peptide Illustrative Identifier Reference | Description/Illustrative Indication(s) |
|---|---|
| FGF-16 GeneSeq Accession Y05474 WO9918128 O43320/FGF16_HUMAN Fibroblast growth factor 16 (SEQ ID NO: 219) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Antagonists may be useful as anti-cancer agents. |
| FGF-18 GeneSeq Accession Y08590 WO9927100 O76093/FGF18_HUMAN Fibroblast growth factor 18 (SEQ ID NO: 220) | Fibroblast Growth Factor Proliferation assay using NR6R-3T3 cells (Rizzino 1988 Cancer Res. 48: 4266); Examples 23 and 39 disclosed herein. Promotion of growth and proliferation of cells, such as epithelial cells and keratinocytes. Antagonists may be useful as anti-cancer agents. |
| flt-3 ligand GeneSeq Accession R67541 EP627487 P49771\|FLT3L_HUMAN Fms-related tyrosine kinase 3 ligand (isoform 1) (SEQ ID NO: 221) | Stem Cell Progenitor Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Promotion of immune cell growth and/or differentiation. |
| VEGF-110 GeneSeq Accession Y69417 WO0013702 SEQ ID NO: 11 from WO0013702 (SEQ ID NO: 222) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |
| VEGF-121 GeneSeq Accession B50432 WO0071713 SEQ ID NO: 2 from WO0071713 (SEQ ID NO: 223) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |
| VEGF-138 GeneSeq Accession Y43483 WO9940197 SEQ ID NO: 4 of WO99/40197 (SEQ ID NO: 371) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |
| VEGF-145 GeneSeq Accession Y69413 WO0013702 SEQ ID NO: 4 from WO0013702 (SEQ ID NO: 224) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |
| VEGF-162 GeneSeq Accession Y43484 WO9940197 SEQ ID NO: 8 of WO99/40197 (SEQ ID NO: 372) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |
| VEGF-165 GeneSeq Accession Y69414 WO0013702 SEQ ID NO: 6 from WO0013702 (SEQ ID NO: 225) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |
| VEGF-182 GeneSeq Accession Y43483 WO9940197 SEQ ID NO: 6 of WO99/40197 (SEQ ID NO: 373) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |
| VEGF-189 GeneSeq Accession Y69415 WO0013702 SEQ ID NO: 8 from WO0013702 (SEQ ID NO: 226) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |

TABLE 2B-continued

Illustrative Proteins, Illustrative Peptides, and Illustrative Indications

Figure 3:
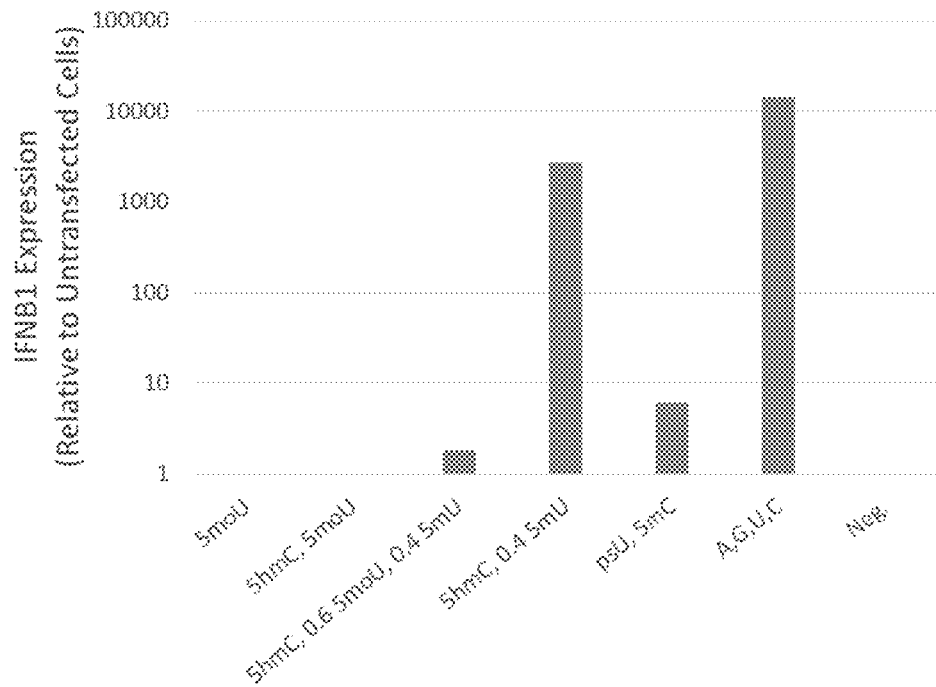
Figure 11:
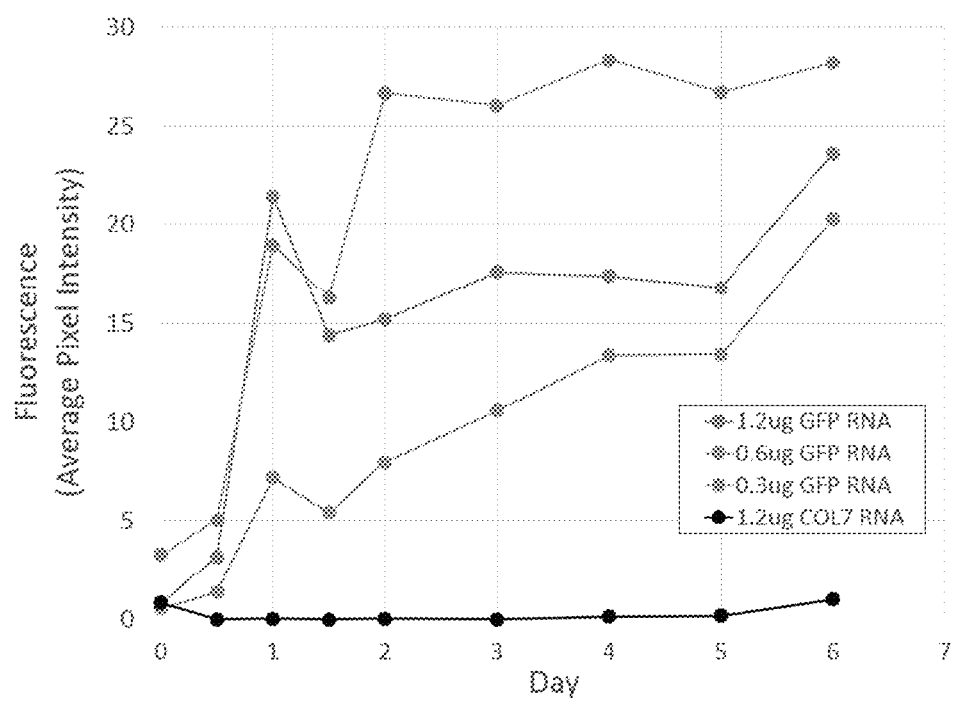
FIG. 11 depicts the results of quantitative fluorescent imaging of the region of FIG. 7, using the FITC fluorescent channel. The horizontal axis indicates time after injection.
Figure 13:
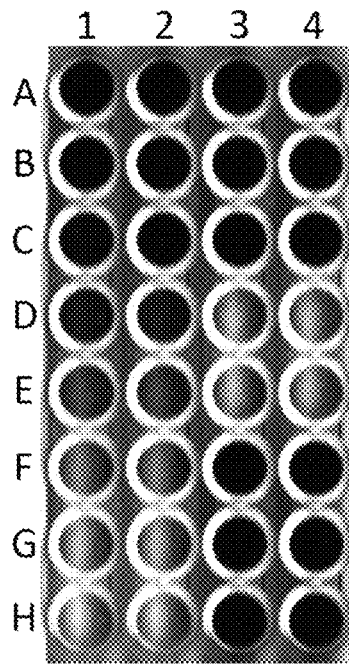
FIG. 13 depicts the results of an ELISA designed to detect darbepoetin alfa in culture media of primary human epidermal keratinocytes transfected with RNA comprising the indicated nucleotides and encoding NOVEPOETIN.
Figure 14:
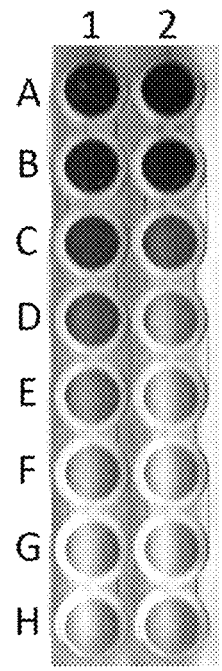
FIG. 14 depicts the results of an ELISA designed to detect darbepoetin alfa in culture media of primary human epidermal keratinocytes transfected with RNA comprising the indicated nucleotides and encoding NOVEPOETIN.

| Protein/Peptide Illustrative Identifier Reference | Description/Illustrative Indication(s) |
|---|---|
| VEGF-206 GeneSeq Accession Y69416 WO0013702 SEQ ID NO: 10 from WO0013702 (SEQ ID NO: 227) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |
| VEGF-D GeneSeq Accession W53240 WO9807832 O43915/VEGFD_HUMAN Vascular endothelial growth factor D (SEQ ID NO: 374) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |
| VEGF-E; VEGF-X GeneSeq Accession Y33679 WO9947677 SEQ ID NO: 2 from WO9947677 (SEQ ID NO: 228) | Promotes the growth and/or proliferation of endothelial cells. VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer. |
| VEGF Receptor; KDR; flk-1 GeneSeq Accession W69679 WO9831794 P35968/VGFR2_HUMAN Vascular endothelial growth factor receptor 2 (isoform 1) (SEQ ID NO: 229) | Receptor for VEGF polypeptides VEGF activity, in the presence of flk-1 polypeptides, can be determined using assays known in the art, such as those disclosed in International Publication No. WO0045835, for example. VEGF Receptor. Fusion protein with the extracellular domain is useful as an antiangiogenic agent. Antagonists may be useful in the promotion of angiogenesis. |
| Soluble VEGF Receptor GeneSeq Accession W47037 U.S. Pat. No. 5,712,380 sVEGF-RI (FIG. 3) of U.S. Pat. No. 5,712,380 (SEQ ID NO: 442) sVEGF-RII (FIG. 11) of U.S. Pat. No. 5,712,380 (SEQ ID NO: 443) sVEGF-RTMI (FIG. 15) of U.S. Pat. No. 5,712,380 (SEQ ID NO: 444) sVEGF-RTMII (FIG. 13) of U.S. Pat. No. 5,712,380 (SEQ ID NO: 445) | Receptor for VEGF polypeptides VEGF activity, in the presence of VEGF Receptor polypeptides, can be determined using assays known in the art, such as those disclosed in International Publication No. WO0045835, for example. VEGF Receptor. Fusion protein with the extracellular domain is useful as an antiangiogenic agent. Antagonists may be useful in the promotion of angiogenesis. |
| flt-1 GeneSeq Accession Y70751 WO0021560 P17948/VGFR1_HUMAN Vascular endothelial growth factor receptor 1 (isoform 1) (SEQ ID NO: 230) | Receptor for VEGF polypeptides VEGF activity, in the presence of flt-1 polypeptides, can be determined using assays known in the art, such as those disclosed in International Publication No. WO0045835, for example. VEGF Receptor. Fusion protein with the extracellular domain is useful as an antiangiogenic agent. Antagonists may be useful in the promotion of angiogenesis. |
| VEGF R-3; flt-4 GeneSeq Accession B29047 WO0058511 P35916/VGFR3_HUMAN Vascular endothelial growth factor receptor 3 (isoform 1) (SEQ ID NO: 231) | Receptor for VEGF polypeptides VEGF activity, in the presence of flt-4 polypeptides, can be determined using assays known in the art, such as those disclosed in International Publication No. WO0045835, for example. VEGF Receptor. Fusion protein with the extracellular domain is useful as an antiangiogenic agent. Antagonists may be useful in the promotion of angiogenesis. |
| Neuropilin-1 GeneSeq Accession Y06319 WO9929858 O14786/NRP1_HUMAN Neuropilin-1 (isoform 1) (SEQ ID NO: 232) | Vascular Endothelial Growth Factor VEGF activity can be determined using assays known in the art, such as those disclosed in International Publication No. WO0045835, for example. Promotion of growth and proliferation of cells, such as vascular endothelial cells. Antagonists may be useful as antiangiogenic agents, and may be applicable for cancer. |
| Neuropilin-2 GeneSeq Accession Y03618 WO9929858 O60462/NRP2_HUMAN Neuropilin-2 (isoform A22) (SEQ ID NO: 233) | Vascular Endothelial Growth Factor VEGF activity can be determined using assays known in the art, such as those disclosed in International Publication No. WO0045835, for example. Promotion of growth and proliferation of cells, such as vascular endothelial cells. Antagonists may be useful as antiangiogenic agents, and may be applicable for cancer. |

TABLE 2B-continued

Illustrative Proteins, Illustrative Peptides, and Illustrative Indications

| Protein/Peptide Illustrative Identifier Reference | Description/Illustrative Indication(s) |
| --- | --- |
| Human fast twitch skeletal muscle troponin C GeneSeq Accession W22597 W09730085 P02585/TNNC2_HUMAN Troponin C, skeletal muscle (SEQ ID NO: 234) | Troponins are contractile proteins that are thought to inhibit angiogenesis. High levels may contribute to the difficulty encountered in revascularizing the ischemic myocardium after cardiovascular injury. Ability of soluble Troponins to inhibit angiogenesis can be determined using assays known in the art:. Proc Natl Acad Sci USA 1999 Mar. 16; 96(6): 2645-50. Anti-angiogenesis |
| Human fast twitch skeletal muscle troponin I GeneSeq Accession W18054 W09730085 P48788/TNNI2_HUMAN Troponin I, fast skeletal muscle (isoform 1) (SEQ ID NO: 235) | Troponins are contractile proteins that are thought to inhibit angiogenesis. High levels may contribute to the difficulty encountered in revascularizing the ischemic myocardium after cardiovascular injury. Ability of soluble Troponins to inhibit angiogenesis can be determined using assays known in the art. Proc Natl Acad Sci USA 1999 Mar. 16; 96(6): 2645-50. Anti-angiogenesis |
| Human fast twitch skeletal muscle troponin T GeneSeq Accession W22599 W09730085 SEQ ID NO: 3 of WO9730085 (SEQ ID NO: 236) | Troponins are contractile proteins that are thought to inhibit angiogenesis. High levels may contribute to the difficulty encountered in revascularizing the ischemic myocardium after cardiovascular injury. Ability of soluble Troponins to inhibit angiogenesis can be determined using assays known in the art:. Proc Natl Acad Sci USA 1999 Mar. 16; 96(6): 2645-50. Anti-angiogenesis |
| fragment. myofibrillar protein troponin I GeneSeq Accession W18053 W09719955 SEQ ID NO: 3 of WO9719955 (SEQ ID NO: 237) | Troponins are contractile proteins that are thought to inhibit angiogenesis. High levels may contribute to the difficulty encountered in revascularizing the ischemic myocardium after cardiovascular injury. Ability of soluble Troponins to inhibit angiogenesis can be determined using assays known in the art:. Proc Natl Acad Sci USA 1999 Mar. 16; 96(6): 2645-50. Anti-angiogenesis |
| myofibrillar protein troponin I GeneSeq Accession W18054 WO9719955 SEQ ID NO: 3 of WO9719955 (SEQ ID NO: 237) | Troponins are contractile proteins that are thought to inhibit angiogenesis. High levels may contribute to the difficulty encountered in revascularizing the ischemic myocardium after cardiovascular injury. Ability of soluble Troponins to inhibit angiogenesis can be determined using assays known in the art:. Proc Natl Acad Sci USA 1999 Mar. 16; 96(6): 2645-50. Anti-angiogenesis |
| Troponin peptides GeneSeq Accessions Y29581, Y29582, Y29583, Y29584, Y29585, and Y29586 WO9933874 Wildtype troponins provided as: Human fast twitch skeletal muscle troponin C GeneSeq Accession W22597 W09730085 P02585/TNNC2_HUMAN Troponin C, skeletal muscle (SEQ ID NO: 234) Human fast twitch skeletal muscle troponin I GeneSeq Accession W18054 W09730085 P48788/TNNI2_HUMAN Troponin I, fast skeletal muscle (isoform 1) (SEQ ID NO: 235) Human fast twitch skeletal muscle troponin T GeneSeq Accession W22599 W09730085 SEQ ID NO: 3 of WO9730085 (SEQ ID NO: 236) | Troponins are contractile proteins that are thought to inhibit angiogenesis. High levels may contribute to the difficulty encountered in revascularizing the ischemic myocardium after cardiovascular injury. Ability of soluble Troponins to inhibit angiogenesis can be determined using assays known in the art:. Proc Natl Acad Sci USA 1999 Mar. 16; 96(6): 2645-50. Anti-angiogenesis |

TABLE 2B-continued

Illustrative Proteins, Illustrative Peptides, and Illustrative Indications

| Protein/Peptide Illustrative Identifier Reference | Description/Illustrative Indication(s) |
|---|---|
| fragment. myofibrillar protein troponin I GeneSeq Accession W18053 W09719955 SEQ ID NO: 3 of WO9719955 (SEQ ID NO: 237) | |
| Human fast twitch skeletal muscle Troponin subunit C GeneSeq Accession B00134 WO0054770 SEQ ID NO: 1 of WO0054770 (SEQ ID NO: 375) | |
| Human fast twitch skeletal muscle Troponin subunit I Protein GeneSeq Accession B00135 WO0054770 SEQ ID NO: 2 of WO0054770 (SEQ ID NO: 376) | |
| Human fast twitch skeletal muscle Troponin subunit T GeneSeq Accession B00136 WO0054770 SEQ ID NO: 3 of WO0054770 (SEQ ID NO: 377) | |
| Human fast twitch skeletal muscle Troponin subunit C GeneSeq Accession B00134 WO0054770 SEQ ID NO: 1 of WO0054770 (SEQ ID NO: 375) | Troponins are contractile proteins that are thought to inhibit angiogenesis. High levels may contribute to the difficulty encountered in revascularizing the ischemic myocardium after cardiovascular injury. Ability of soluble Troponins to inhibit angiogenesis can be determined using assays known in the art:. Proc Natl Acad Sci USA 1999 Mar. 16; 96(6): 2645-50. Anti-angiogenesis |
| Human fast twitch skeletal muscle Troponin subunit I Protein GeneSeq Accession B00135 WO0054770 SEQ ID NO: 2 of WO0054770 (SEQ ID NO: 376) | Troponins are contractile proteins that are thought to inhibit angiogenesis. High levels may contribute to the difficulty encountered in revascularizing the ischemic myocardium after cardiovascular injury. Ability of soluble Troponins to inhibit angiogenesis can be determined using assays known in the art:. Proc Natl Acad Sci USA 1999 Mar. 16; 96(6): 2645-50. Anti-angiogenesis |
| Human fast twitch skeletal muscle Troponin subunit T GeneSeq Accession B00136 WO0054770 SEQ ID NO: 3 of WO0054770 (SEQ ID NO: 377) | Troponins are contractile proteins that are thought to inhibit angiogenesis. High levels may contribute to the difficulty encountered in revascularizing the ischemic myocardium after cardiovascular injury. Ability of soluble Troponins to inhibit angiogenesis can be determined using assays known in the art:. Proc Natl Acad Sci USA 1999 Mar. 16; 96(6): 2645-50. Anti-angiogenesis |
| Activator Inhibitor-1; PAI-1 GeneSeq Accession R08411 WO9013648 P05121/PAI1_HUMAN Plasminogen activator inhibitor 1 (isoform 1) (SEQ ID NO: 238) | PAIs are believed to play a role in cancer, and cardiovascular disease and blood-clotting disorders. Methods that measure plasminogen activator inhibitor (PAI) activity are known in the art, for example, assay the ability of PAI to inhibit tissue plasminogen activator (tPA) or urokinase (uPA): J Biochem Biophys Methods 2000 Sep. 11; 45(2): 127-40, Breast Cancer Res Treat 1996; 41(2): 141-6. Methods that measure anti- angiogenesis activity are known in the art, for example, Proc Natl Acad Sci USA 1999 Mar. 16; 96(6): 2645-50. Anti-angiogenesis; blood-clotting disorders. |
| Plasminogen Activator Inhibitor-2; PAI-2 GeneSeq Accession P94160 DE3722673 P05120/PAI2_HUMAN Plasminogen activator inhibitor 2 (SEQ ID NO: 239) | PAIs are believed to play a role in cancer, and cardiovascular disease and blood-clotting disorders. Methods that measure plasminogen activator inhibitor (PAI) activity are known in the art, for example, assay the ability of PAI to inhibit tissue plasminogen activator (tPA) or urokinase (uPA): J Biochem Biophys Methods 2000 Sep. 11; 45(2): 127-40, Breast Cancer Res Treat 1996; 41(2): 141-6. Methods that measure anti- angiogenesis activity are known in the art, for example, Proc Natl Acad Sci USA 1999 Mar. 16; 96(6): 2645-50. Anti-angiogenesis; blood-clotting disorders. |
| Activator Inhibitor-2; PAI-2 GeneSeq Accession R10921 WO9102057 P05120/PAI2_HUMAN Plasminogen activator inhibitor 2 (SEQ ID NO: 239) | PAIs are believed to play a role in cancer, and cardiovascular disease and blood-clotting disorders. Methods that measure plasminogen activator inhibitor (PAI) activity are known in the art, for example, assay the ability of PAI to inhibit tissue plasminogen activator (tPA) or urokinase (uPA): J Biochem Biophys Methods 2000 Sep. 11; 45(2): 127-40, Breast Cancer Res Treat 1996; 41(2): 141-6. Methods that measure anti- angiogenesis activity are known in the art, for example, Proc Natl Acad Sci USA 1999 Mar. 16; 96(6): 2645-50. Anti-angiogenesis; blood-clotting disorders. |

TABLE 2B-continued

Illustrative Proteins, Illustrative Peptides, and Illustrative Indications

| Protein/Peptide Illustrative Identifier Reference | Description/Illustrative Indication(s) |
|---|---|
| Human PAI-1 mutants GeneSeq Accessions R11755, R11756, R11757, R11758, R11759, R11760, R11761, R11762 and R11763 WO9105048 Wildtype PAI-1 is provided as P05121/PAI1_HUMAN Plasminogen activator inhibitor 1 (isoform 1) (SEQ ID NO: 238) | PAIs are believed to play a role in cancer, and cardiovascular disease and blood-clotting disorders. Methods that measure plasminogen activator inhibitor (PAI) activity are known in the art, for example, assay the ability of PAI to inhibit tissue plasminogen activator (tPA) or urokinase (uPA): J Biochem Biophys Methods 2000 Sep. 11; 45(2): 127-40, Breast Cancer Res Treat 1996; 41(2): 141-6. Methods that measure anti-angiogenesis activity are known in the art, for example, Proc Natl Acad Sci USA 1999 Mar. 16; 96(6): 2645-50. Anti-angiogenesis; blood-clotting disorders. |
| CXCR3; CXC GeneSeq Accession Y79372 WO0018431 P49682|CXCR3_HUMAN C-X-C chemokine receptor type 3 (isoform 1) (SEQ ID NO: 240) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Soluble CXCR3 polypeptides may be useful for inhibiting chemokine activities and viral infection. |
| Modified Rantes GeneSeq Accession W38129 WO9737005 Wildtype Rantes provided herein as P13501/CCL5_HUMAN C-C motif chemokine 5 (SEQ ID NO: 241) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| RANTES GeneSeq Accession Y05299 EP905240 P13501/CCL5_HUMAN C-C motif chemokine 5 (SEQ ID NO: 241) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| MCP-Ia GeneSeq Accession R73914 WO9509232 MCP-1 provided as P13500/CCL2_HUMAN C-C motif chemokine 2 (SEQ ID NO: 337) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| MCP-Ib GeneSeq Accession Y26176 WO9929728 MCP-1 provided as P13500/CCL2_HUMAN C-C motif chemokine 2 (SEQ ID NO: 337) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| MCP-I receptor GeneSeq Accession R79165 WO9519436 MCP-IA SEQ ID NO: 2 of WO9519436 (SEQ ID NO: 446) MCP-1B SEQ ID NO: 4 of WO9519436 (SEQ ID NO: 447) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Soluble MCP-1 Receptor polypep- tides may be useful for inhibiting chemokine activities and viral infection. |

TABLE 2B-continued

Illustrative Proteins, Illustrative Peptides, and Illustrative Indications

| Protein/Peptide Illustrative Identifier Reference | Description/Illustrative Indication(s) |
|---|---|
| MCP-3 GeneSeq Accession R73915 W09509232 P80098/CCL7_HUMAN C-C motif chemokine 7 (SEQ ID NO: 336) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| MCP-4 receptor GeneSeq Accession W56689 WO9809171 SEQ ID NO: 2 of WO9809171 (SEQ ID NO: 378) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Soluble MCP-4 Receptor polypeptides may be useful for inhibiting chemokine activities and viral infection. |
| RANTES receptor GeneSeq Accession W29588 U.S. Pat. No. 5,652,133 SEQ ID NO: 2 of U.S. Pat. No. 5,652,133 (SEQ ID NO: 379) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Soluble RANTES Receptor polypeptides may be useful for inhibiting chemokine activities and viral infection. |
| CCR5 variant GeneSeq Accession W88238 WO9854317 Variants of wildtype CCR5 which has the sequence of: P51681|CCR5_HUMAN C-C chemokine receptor type 5 (SEQ ID NO: 448) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Soluble CCR5 polypeptides may be useful for inhibiting chemokine activities and viral infection. |
| CCR7 GeneSeq Accession B50859 U.S. Pat. No. 6,153,441 P32248/CCR7_HUMAN C-C chemokine receptor type 7 (SEQ ID NO: 243) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Soluble CCR7 polypeptides may be useful for inhibiting chemokine activities and viral infection. |
| CXC3 GeneSeq Accession W23345 WO9727299 P78423/X3CL1_HUMAN Fractalkine (SEQ ID NO: 244) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| Eotaxin GeneSeq Accession W10099 WO9700960 P51671/CCL11_HUMAN Eotaxin (SEQ ID NO: 245) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |

TABLE 2B-continued

Illustrative Proteins, Illustrative Peptides, and Illustrative Indications

| Protein/Peptide Illustrative Identifier Reference | Description/Illustrative Indication(s) |
|---|---|
| Neurotactin GeneSeq Accessions Y77537, W34307, Y53259, and, Y77539 U.S. Pat. No. 6,013,257 WO9742224 P78423/X3CL1_HUMAN Fractalkine (SEQ ID NO: 244) | Neurotactin may play a role in chemotactic leukocyte migration and brain inflammation processes. Chemotactic leukocyte migration assays are known in the art, for example: J. Immunol. Methods 33, ((1980)); Nature 1997 Jun. 5; 387(6633): 611-7. Immune disorders. |
| Human CKbeta-9 GeneSeq Accession B50860 U.S. Pat. No. 6,153,441 SEQ ID NO: 2 of U.S. Pat. No. 6,153,441 (SEQ ID NO: 246) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| Lymphotactin GeneSeq Accession B50052 WO0073320 P47992/XCL1_HUMAN Lymphotactin (SEQ ID NO: 247) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| MIP-3 alpha GeneSeq Accession W44398 WO9801557 P78556/CCL20_HUMAN C-C motif chemokine 20 (isoform 1) (SEQ ID NO: 248) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| MIP-3 beta GeneSeq Accession W44399 WO9801557 Q99731/CCL19_HUMAN C-C motif chemokine 19 (SEQ ID NO: 249) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| MIP-Gamma GeneSeq Accession R70798 WO2006135382 (SEQ ID NO: 457) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| Stem Cell Inhibitory Factor GeneSeq Accession R11553 WO9104274 SCIF in Table I of WO9104274 (SEQ ID NO: 380) SCIF in Table II of WO9104274 (SEQ ID NO: 381) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Hematopoietic growth factors. |
| Thrombopoietin GeneSeq Accession R79905 WO9521920 P40225|TPO_HUMAN Thrombopoietin (isoform 1) (SEQ ID NO: 250) | Thrombopoietin is involved in the regulation of the growth and differentiation of megakaryocytes and preceptors thereof. Thrombopoietin (TPO) can be assayed to determine regulation of growth and differentiation of megakaryocytes. Mol Cell Biol 2001 April; 21(8): 2659-70; Exp Hematol 2001 January; 29(1): 51-8 and within. Hematopoietic growth factors. |

TABLE 2B-continued

Illustrative Proteins, Illustrative Peptides, and Illustrative Indications

| Protein/Peptide Illustrative Identifier Reference | Description/Illustrative Indication(s) |
|---|---|
| c-kit ligand; SCF; Mast cell growth factor; MGF; Fibrosarcoma- derived stem cell factor GeneSeq Accession Y53284, R83978 and R83977 EP992579 and EP676470 P21583\|SCF_HUMAN Kit ligand (isoform 1) (SEQ ID NO: 251) | C-kit ligan is thought to stimulate the proliferation of mast cells, and is able to augment the proliferation of both myeloid and lymphoid hematopoietic progenitors in bone marrow culture. C-kit ligand is also though to act synergistically with other cytokines. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Hematopoietic growth factors. |
| Platelet derived growth factor GeneSeq Accession B48653 WO0066736 PDGF-A P04085/PDGFA_HUMAN Platelet-derived growth factor subunit A (Isoform long) (SEQ ID NO: 257) PDGF-B P01127/PDGFB_HUMAN Platelet-derived growth factor subunit B (isoform 1) (SEQ ID NO: 258) | Vascular Endothelial Growth Factor VEGF activity can be determined using assays known in the art, such as those disclosed in International Publication No. WO0045835, for example. Promotion of growth and proliferation of cells, such as vascular endothelial cells. Antagonists may be useful as antiangiogenic agents, and may be applicable for cancer. |
| Melanoma inhibiting protein GeneSeq Accession R69811 WO9503328 (SEQ ID NO: 458) | Melanoma inhibiting protein has melanoma-inhibiting activity and can be used to treat cancer (melanoma, glioblastoma, neuroblastoma, small cell lung cancer, neuroectodermal tumors) or as an immunosuppressant (it inhibits IL-2 or phytohaemagglutinin induced proliferation of peripheral blood lymphocytes. Tumor suppressor activity of melanoma inhibiting protein can be determined using assays known in the art: Matzuk et al., Nature 1992 Nov. 26; 360(6402): 313-9. Cancer; melanoma |
| Glioma-derived growth factor GeneSeq Accession R08120 EP399816 | Vascular Endothelial Growth Factor VEGF activity can be determined using assays known in the art, such as those disclosed in International Publication No. WO0045835, for example. Promotion of growth and proliferation of cells, such as vascular endothelial cells. Antagonists may be useful as antiangiogenic agents, and may be applicable for cancer. |
| Platelet derived growth factor precursor A GeneSeq Accession R84759 EP682110 PDGF-A precursor (variant D1) (SEQ ID NO: 382) PDGF-A precursor (variant 13-1) (SEQ ID NO: 383) | Vascular Endothelial Growth Factor VEGF activity can be determined using assays known in the art, such as those disclosed in International Publication No. WO0045835, for example. Promotion of growth and proliferation of cells, such as vascular endothelial cells. Antagonists may be useful as antiangiogenic agents, and may be applicable for cancer. |
| Platelet derived growth factor precursor B GeneSeq Accession R84760 EP682110, FIG. 1 or FIG. 2 Wildtype PDGF-B provided as: PDGF-B P01127/PDGFB_HUMAN Platelet-derived growth factor subunit B (isoform 1) (SEQ ID NO: 258) | Vascular Endothelial Growth Factor VEGF activity can be determined using assays known in the art, such as those disclosed in International Publication No. WO0045835, for example. Promotion of growth and proliferation of cells, such as vascular endothelial cells. Antagonists may be useful as antiangiogenic agents, and may be applicable for cancer. |
| Platelet derived growth factor Bvsis GeneSeq Accession P80595 and P80596 EP282317 FIG. 1 of EP282317 (SEQ ID NO: 384) | Vascular Endothelial Growth Factor VEGF activity can be determined using assays known in the art, such as those disclosed in International Publication No. WO0045835, for example. Promotion of growth and proliferation of cells, such as vascular endothelial cells. Antagonists may be useful as antiangiogenic agents, and may be applicable for cancer. |

TABLE 2B-continued

Illustrative Proteins, Illustrative Peptides, and Illustrative Indications

| Protein/Peptide Illustrative Identifier Reference | Description/Illustrative Indication(s) |
|---|---|
| Placental Growth Factor GeneSeq Accessions R23059 and R23060 WO9206194 P49763-2/PLGF__HUMAN Isoform PIGF-1 of Placenta growth factor (isoform PIGF-1) (SEQ ID NO: 252) | Vascular Endothelial Growth Factor VEGF activity can be determined using assays known in the art, such as those disclosed in International Publication No. WO0045835, for example. Promotion of growth and proliferation of cells, such as vascular endothelial cells. Antagonists may be useful as antiangiogenic agents, and may be applicable for cancer. |
| Placental Growth Factor-2 GeneSeq Accession Y08289 DE19748734 P49763-3/PLGF__HUMAN Isoform PIGF-2 of Placenta growth factor (isoform PIGF-2) (SEQ ID NO: 253) | Vascular Endothelial Growth Factor VEGF activity can be determined using assays known in the art, such as those disclosed in International Publication No. WO0045835, for example. Promotion of growth and proliferation of cells, such as vascular endothelial cells. Antagonists may be useful as antiangiogenic agents, and may be applicable for cancer. |
| Thrombopoietin derivative1 GeneSeq Accession Y77244 WO0000612 (e.g. Table 3) Wildtype thrombopoietin provided as: P40225\|TPO__HUMAN Thrombopoietin (isoform 1) (SEQ ID NO: 250) | Thrombopoietin is involved in the regulation of the growth and differentiation of megakaryocytes and preceptors thereof. Thrombopoietin (TPO) can be assayed to determine regulation of growth and differentiation of megakaryocytes. Mol Cell Biol 2001 April; 21(8): 2659-70; Exp Hematol 2001 January; 29(1): 51-8 and within. Thrombocytopenia, cancer. |
| Thrombopoietin derivative2 GeneSeq Accession Y77255 WO0000612 (e.g. Table 3) Wildtype thrombopoietin provided as: P40225\|TPO__HUMAN Thrombopoietin (isoform 1) (SEQ ID NO: 250) | Thrombopoietin is involved in the regulation of the growth and differentiation of megakaryocytes and preceptors thereof. Thrombopoietin (TPO) can be assayed to determine regulation of growth and differentiation of megakaryocytes. Mol Cell Biol 2001 April; 21(8): 2659-70; Exp Hematol 2001 January; 29(1): 51-8 and within. Thrombocytopenia, cancer. |
| Thrombopoietin derivative 3 GeneSeq Accession Y77262 WO0000612 (e.g. Table 3) Wildtype thrombopoietin provided as: P40225\|TPO__HUMAN Thrombopoietin (isoform 1) (SEQ ID NO: 250) | Thrombopoietin is involved in the regulation of the growth and differentiation of megakaryocytes and preceptors thereof. Thrombopoietin (TPO) can be assayed to determine regulation of growth and differentiation of megakaryocytes. Mol Cell Biol 2001 April; 21(8): 2659-70; Exp Hematol 2001 January; 29(1): 51-8 and within. Thrombocytopenia, cancer. |
| Thrombopoietin derivative 4 GeneSeq Accession Y77267 WO0000612 (e.g. Table 3) Wildtype thrombopoietin provided as: P40225\|TPO__HUMAN Thrombopoietin (isoform 1) (SEQ ID NO: 250) | Thrombopoietin is involved in the regulation of the growth and differentiation of megakaryocytes and preceptors thereof. Thrombopoietin (TPO) can be assayed to determine regulation of growth and differentiation of megakaryocytes. Mol Cell Biol 2001 April; 21(8): 2659-70; Exp Hematol 2001 January; 29(1): 51-8 and within. Thrombocytopenia, cancer. |
| Thrombopoietin derivative 5 GeneSeq Accession Y77246 WO0000612 (e.g. Table 3) Wildtype thrombopoietin provided as: P40225\|TPO__HUMAN Thrombopoietin (isoform 1) (SEQ ID NO: 250) | Thrombopoietin is involved in the regulation of the growth and differentiation of megakaryocytes and preceptors thereof. Thrombopoietin (TPO) can be assayed to determine regulation of growth and differentiation of megakaryocytes. Mol Cell Biol 2001 April; 21(8): 2659-70; Exp Hematol 2001 January; 29(1): 51-8 and within. Thrombocytopenia, cancer. |

TABLE 2B-continued

Illustrative Proteins, Illustrative Peptides, and Illustrative Indications

| Protein/Peptide Illustrative Identifier Reference | Description/Illustrative Indication(s) |
|---|---|
| Thrombopoietin derivative 6 GeneSeq Accession Y77253 WO0000612 (e.g. Table 3) Wildtype thrombopoietin provided as: P40225\|TPO_HUMAN Thrombopoietin (isoform 1) (SEQ ID NO: 250) | Thrombopoietin is involved in the regulation of the growth and differentiation of megakaryocytes and preceptors thereof. Thrombopoietin (TPO) can be assayed to determine regulation of growth and differentiation of megakaryocytes. Mol Cell Biol 2001 April; 21(8): 2659-70; Exp Hematol 2001 January; 29(1): 51-8 and within. Thrombocytopenia, cancer. |
| Thrombopoietin derivative 7 GeneSeq Accession Y77256 WO0000612 (e.g. Table 3) Wildtype thrombopoietin provided as: P40225\|TPO_HUMAN Thrombopoietin (isoform 1) (SEQ ID NO: 250) | Thrombopoietin is involved in the regulation of the growth and differentiation of megakaryocytes and preceptors thereof. Thrombopoietin (TPO) can be assayed to determine regulation of growth and differentiation of megakaryocytes. Mol Cell Biol 2001 April; 21(8): 2659-70; Exp Hematol 2001 January; 29(1): 51-8 and within. Thrombocytopenia, cancer. |
| Fractalkine GeneSeq Accession Y53255 U.S. Pat. No. 6,043,086 P78423/X3CL1_HUMAN Fractalkine (SEQ ID NO: 244) | Fractalkine is believed to play a role in chemotactic leukocyte migration and neurological disorders. Fractalkine activity can be determined using Chemotactic leukocyte migration assays known in the art, for example: J. Immunol. Methods 33, ((1980)); Nature 1997 Jun. 5; 387(6633): 611-7. Immune disorders. |
| CXC3 GeneSeq Accession W23345 WO9757599 P78423/X3CL1_HUMAN Fractalkine (SEQ ID NO: 244) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders. |
| CCR7 GeneSeq Accession B50859 U.S. Pat. No. 6,153,441 P32248/CCR7_HUMAN C-C chemokine receptor type 7 (SEQ ID NO: 243) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Soluble CCR7 polypeptides may be useful for inhibiting chemokine activities and viral infection. |
| Nerve Growth Factor-beta GeneSeq Accession R11474 EP414151 P01138/NGF_HUMAN Beta-nerve growth factor (SEQ ID NO: 254) | Nerve Growth Factor Proliferation assay using NR6R-3T3 cells (Rizzino 1988 Cancer Res. 48: 4266) Neurological disorders, cancer |
| Nerve Growth Factor-beta2 GeneSeq Accession W69725 EP859056 FIG. 1 of EP859056 (SEQ ID NO: 465) | Nerve Growth Factor Proliferation assay using NR6R 3T3 cells (Rizzino 1988 Cancer Res. 48: 4266 Neurological disorders, cancer |
| Neurotrophin-3 GeneSeq Accession W8889 WO9821234 P20783/NTF3_HUMAN Neurotrophin-3 (isoform 1) (SEQ ID NO: 255) | Neurotrophins regulate neuronal cell survival and synaptic plasticity. Trk tyrosine kinase activation assays known in the art can be used to assay for neurotrophin activity, for example, Proc Natl Acad Sci USA 2001 Mar. 13; 98(6): 3555-3560. Neurological disorders, cancer |
| Neurotrophin-4 GeneSeq Accession R47100 WO9325684 P34130/NTF4_HUMAN Neurotrophin-4 (SEQ ID NO: 256) | Neurotrophins regulate neuronal cell survival and synaptic plasticity. Trk tyrosine kinase activation assays known in the art can be used to assay for neurotrophin activity, for example, Proc Natl Acad Sci USA 2001 Mar. 13; 98(6): 3555-3560. Neurological disorders, cancer |

TABLE 2B-continued

Illustrative Proteins, Illustrative Peptides, and Illustrative Indications

| Protein/Peptide Illustrative Identifier Reference | Description/Illustrative Indication(s) |
|---|---|
| Neurotrophin- 4a GeneSeq Accession R47101 WO9325684 Wildtype neurotrophin provided as: P34130/NTF4_HUMAN Neurotrophin-4 (SEQ ID NO: 256) | Neurotrophins regulate neuronal cell survival and synaptic plasticity. Trk tyrosine kinase activation assays known in the art can be used to assay for neurotrophin activity, for example, Proc Natl Acad Sci USA 2001 Mar. 13; 98(6): 3555-3560. Neurological disorders, cancer |
| Neurotrophin- 4b GeneSeq Accession R47102 WO9325684 P34130/NTF4_HUMAN Neurotrophin-4 (SEQ ID NO: 256) | Neurotrophins regulate neuronal cell survival and synaptic plasticity. tyrosine kinases. Trk tyrosine kinase activation assays known in the art can be used to assay for neurotrophin activity, for example, Proc Natl Acad Sci USA 2001 Mar. 13; 98(6): 3555-3560. Neurological disorders, cancer |
| Neurotrophin- 4c GeneSeq Accession R47103 WO9325684 P34130/NTF4_HUMAN Neurotrophin-4 (SEQ ID NO: 256) | Neurotrophins regulate neuronal cell survival and synaptic plasticity. tyrosine kinases. Trk tyrosine kinase activation assays known in the art can be used to assay for neurotrophin activity, for example, Proc Natl Acad Sci USA 2001 Mar. 13; 98(6): 3555-3560. Neurological disorders, cancer |
| Neurotrophin- 4d GeneSeq Accession R47102 WO9325684 P34130/NTF4_HUMAN Neurotrophin-4 (SEQ ID NO: 256) | Neurotrophins regulate neuronal cell survival and synaptic plasticity. tyrosine kinases. Trk tyrosine kinase activation assays known in the art can be used to assay for neurotrophin activity, for example, Proc Natl Acad Sci USA 2001 Mar. 13; 98(6): 3555-3560. Neurological disorders, cancer |
| Platelet-Derived Growth Factor A chain GeneSeq Accession R38918 U.S. Pat. No. 5,219,739 P04085/PDGFA_HUMAN Platelet-derived growth factor subunit A (Isoform long) (SEQ ID NO: 257) | Vascular Endothelial Growth Factor VEGF activity can be determined using assays known in the art, such as those disclosed in International Publication No. WO00045835, for example. Promotion of growth and proliferation of cells, such as vascular endothelial cells. Hematopoietic and immune dis- orders. Antagonists may be useful as anti-angiogenic agents, and may be applicable for cancer |
| Platelet-Derived Growth Factor B chain GeneSeq Accession R38919 U.S. Pat. No. 5,219,739 P01127/PDGFB_HUMAN Platelet-derived growth factor subunit B (isoform 1) (SEQ ID NO: 258) | Vascular Endothelial Growth Factor VEGF activity can be determined using assays known in the art, such as those disclosed in International Publication No. WO00045835, for example. Promotion of growth and proliferation of cells, such as vascular endothelial cells. Hematopoietic and immune dis- orders. Antagonists may be useful as anti-angiogenic agents, and may be applicable for cancer |
| Stromal Derived Factor- 1 alpha GeneSeq Accession Y39995 WO9948528 P48061-2/SDF1_HUMAN Isoform Alpha of Stromal cell-derived factor 1 (isoform alpha) (SEQ ID NO: 259) | Stromal Growth Factor Proliferation assay using NR6R-3T3 cells (Rizzino 1988 Cancer Res. 48: 4266) Hematopoietic, immune disorders, cancer |
| Stromal Derived Factor- 1 beta GeneSeq Accession R75420 CA2117953 P48061/SDF1_HUMAN Stromal cell-derived factor 1 (isoform beta) (SEQ ID NO: 260) | Stromal Growth Factor Proliferation assay using NR6R-3T3 cells (Rizzino 1988 Cancer Res. 48: 4266) Hematopoietic, immune disorders, cancer |
| Tarc GeneSeq Accession W14917 WO9711969 Q92583/CCL17_HUMAN C-C motif chemokine 17 (SEQ ID NO: 261) | Chemotactic for T lymphocytes. May play a role in T-cell development. Thought to bind CCR8 and CCR4 Chemotactic leukocyte migration assays are known in the art, for example: J. Immunol. Methods 33 ((1980)) Antiinflammatory. Immune disorders, cancer |
| Prolactin GeneSeq Accession R78691 WO9521625 P01236/PRL_HUMAN Prolactin (SEQ ID NO: 262) | Prolactin is involved in immune cell proliferation and apoptosis. Immune coil proliferation and suppression of apoptosis by prolactin can be assayed by methods well-known in the art, for example, Buckley, AR and Buckley DJ, Ann N Y Acad Sci 2000; 917: 522-33, and within. Reproductive system disorders, cancer. |

TABLE 2B-continued

Illustrative Proteins, Illustrative Peptides, and Illustrative Indications

| Protein/Peptide Illustrative Identifier Reference | Description/Illustrative Indication(s) |
|---|---|
| Prolactin2 GeneSeq Accession Y31764 U.S. Pat. No. 5,955,346 | Prolactin is involved in immune cell proliferation and apoptosis. Immune coil proliferation and suppression of apoptosis by prolactin can be assayed by methods well-known in the art, for example, Buckley, AR and Buckley DJ, Ann N Y Acad Sci 2000; 917: 522-33, and within. Reproductive system disorders, cancer. |
| Follicle stimulating hormone Alpha subunit GeneSeq Accession Y54160 EP974359 P01215/GLHA_HUMAN Glycoprotein hormones alpha chain (SEQ ID NO: 263) | FSH stimulates secretion of interleukin-1 by cells isolated from women in the follicular phase FSH activities can be determined using assays known in the art; J Gend Specif Med 1999 November-December; 2(6): 30-4; Mol Cell Endocrinol. 1997 Nov. 15; 134(2): 109-18. Reproductive system disorders, cancer. |
| Follicle stimulating hormone Beta subunit GeneSeq Accession Y54161 EP974359 P01225/FSHB_HUMAN Follitropin subunit beta (SEQ ID NO: 264) | FSH stimulates secretion of interleukin-1 by cells isolated from women in the follicular phase FSH activities can be determined using assays known in the art; J Gend Specif Med 1999 November-December; 2(6): 30-4; Mol Cell Endocrinol. 1997 Nov. 15; 134(2): 109-18. Reproductive system disorders, cancer. |
| Substance P (tachykinin) GeneSeq Accession B23027 WO0054053 (SEQ ID NO: 385) | Substance P is associated with immunoregulation. Immuneregulation and bone marrow, cell proliferation by substance P can be assayed by methods well-known in the art, for example, Lai et al. Proc Natl Acad Sci USA 2001 Mar. 27; 98(7): 3970-5; Jallat-Daloz et al. Allergy Asthma Proc 2001 January-February; 22(1): 17-23; Kehler et al. Exp Lung Res 2001 January-February; 27(1): 25-46; and Adamus MA and Dabrowski ZJ. J Cell Biochem 2001; 81(3)499-506. diabetes mellitus, hypertension, cancer |
| Oxytocin (Neurophysin I) GeneSeq Accession B24085 and B24086 WO0053755 P01178/NEU1_HUMAN Oxytocin-neurophysin 1 (SEQ ID NO: 265) | Oxytocin is involved in the induction of prostaglandin (E2) release as well as an increased amount of calcium release by smooth muscle cells. Oxytocin and prostaglandin E(2) release and Ocytocin (Ca2+) increase can be assayed by methods well-known in the art, for example, Pavan et al., AM J Obset Gynecol 2000 July; 183(1): 76-82 and Holda et al., Cell Calcium 1996 July; 20(1): 43 51. inflammatory disorders immunologic disorders, cancer |
| Vasopressin (Neurophysin II) GeneSeq Accession B24085 and B24086 WO0053755 P01185/NEU2_HUMAN Vasopressin-neurophysin 2-copeptin (SEQ ID NO: 266) | Vasopressinis believed to have a direct antidiuretic action on the kidney, and it is thought to cause vasoconstriction of the peripheral vessels. Vasopressin activity can be determined using assays known in the art, for example, Endocr Regul 1996 March; 30(I): 13-17. inflammatory disorders immunologic disorders, cancer |
| IL-1 GeneSeq Accession P60326 EP165654 IL-1 alpha P01583\|IL1A_HUMAN Interleukin-1 alpha (SEQ ID NO: 269) IL-1 beta P01584\|IL1B_HUMAN Interleukin-1 beta (SEQ ID NO: 267) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarclio (1989) Cytokine 1, 14-20. inflammatory disorders immunologic disorders, cancer |
| IL-1 mature GeneSeq Accession R14855 EP456332 (mature truncated form wherein the precursor is cleaved between amino acids 116-117) (SEQ ID NO: 386) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarclio (1989) Cytokine 1, 14-20. inflammatory disorders immunologic disorders, cancer |
| IL-1 beta GeneSeq Accession Y08322 WO9922763 P01584\|IL1B_HUMAN Interleukin-1 beta (SEQ ID NO: 267) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarclio (1989) Cytokine 1, 14-20. inflammatory disorders immunologic disorders, cancer |
| IL-3 variants GeneSeq Accession P80382, P80383, P80384, and | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis |

TABLE 2B-continued

Illustrative Proteins, Illustrative Peptides, and Illustrative Indications

| Protein/Peptide Illustrative Identifier Reference | Description/Illustrative Indication(s) |
|---|---|
| P80381 WO8806161 Variants of wildtype IL-3 which has the sequence: P08700\|IL3_HUMAN Interleukin-3 (SEQ ID NO: 449) | of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Kitamura et al (1989) J Cell Physiol. 140 323-334. inflammatory disorders immunologic disorders, cancer |
| IL-4 GeneSeq Accession P70615 WO8702990 P05112/IL4_HUMAN Interleukin-4 (isoform 1) (SEQ ID NO: 268) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Siegel & Mostowski (1990) J Immunol Methods 132, 287-295. inflammatory disorders immunologic disorders, cancer |
| IL-4 muteins GeneSeq Accession W52151 W52152 W52153 W52154 W52155 W52156 W52157 W52158 W52159 W52160 W52161 W52162 W52163 W52164 and W52165 WO9747744 Variants of wildtype IL-4 which has the sequence: P05112/IL4_HUMAN Interleukin-4 (isoform 1) (SEQ ID NO: 268) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Siegel & Mostowski (1990) J Immunol Methods 132, 287-295. inflammatory disorders immunologic disorders, cancer |
| IL-1 alpha GeneSeq Accession P90108 EP324447 P01583\|IL1A_HUMAN Interleukin-1 alpha (SEQ ID NO: 269) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarclio (1989) Cytokine 1, 14-20. inflammatory disorders immunologic disorders, cancer |
| IL-3 variants GeneSeq Accession R38561, R38562, R38563, R38564, R38565, R38566, R38567, R38568, R38569, R38570, R38571, and R38572 WO9307171 Variants of wildtype IL-3 which has the sequence: P08700\|IL3_HUMAN Interleukin-3 (SEQ ID NO: 449) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Aarden et al (1987) Eur. J. Immunol 17, 1411-16. inflammatory disorders immunologic disorders, cancer |
| IL-6 GeneSeq Accession R45717 and R45718 WO9402512 P05231/IL6_HUMAN Interleukin-6 (SEQ ID NO: 270) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Aarden et al (1987) Eur. J. Immunol 17, 1411-16. inflammatory disorders immunologic disorders, cancer. Obesity. Metabolic Disease. Diabetes. |
| IL-13 GeneSeq Accession R48624 WO9404680 P35225/IL13_HUMAN Interleukin-13 (SEQ ID NO: 271) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Boutelier et al (1995) J. Immunol. Methods 181, 29. inflammatory disorders immunologic disorders, cancer |
| IL-4 mutein GeneSeq Accession R47182 DE4137333 Variants of wildtype IL-4 which has the sequence: P05112/IL4_HUMAN Interleukin-4 (isoform 1) (SEQ ID NO: 268) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Siegel & Mostowski (1990) J Immunol Methods 132, 287-295. inflammatory disorders immunologic disorders, cancer |

TABLE 2B-continued

Illustrative Proteins, Illustrative Peptides, and Illustrative Indications

| Protein/Peptide Illustrative Identifier Reference | Description/Illustrative Indication(s) |
|---|---|
| IL-4 mutein Y124X GeneSeq Accession R47183 DE4137333 Variants of wildtype IL-4 which has the sequence: P05112/IL4_HUMAN Interleukin-4 (isoform 1) (SEQ ID NO: 268)) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-

TABLE 2B-continued

Illustrative Proteins, Illustrative Peptides, and Illustrative Indications

| Protein/Peptide Illustrative Identifier Reference | Description/Illustrative Indication(s) |
|---|---|
| | D.C. 1987, pp. 221-225; and Orencole & Dinarclio (1989) inflammatory disorders immunologic disorders, cancer |
| ICE 22 kD subunit. GeneSeq Accession R33780 EP533350 SEQ ID NO: 16 of EP533350 (SEQ ID NO: 450) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| ICE 20 kD subunit. GeneSeq Accession R33781 EP533350 SEQ ID NO: 17 of EP533350 (SEQ ID NO: 451) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| ICE 10 kD subunit GeneSeq Accession R33782 EP533350 SEQ ID NO: 18 of EP533350 (SEQ ID NO: 452) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| Human Interleukin-10 (precursor) GeneSeq Accession R41664 WO9317698 P22301/IL10_HUMAN Interleukin-10 (precursor form is processed into a truncated mature form) (SEQ ID NO: 272) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Thompson-Snipes et al (1991) J. Exp. Med. 173, 507-510. inflammatory disorders immunologic disorders, cancer |
| Human Interleukin-10 GeneSeq Accession R42642 WO9318783 SEQ ID NO: 3 of WO9318783-A (mature IL-10) (SEQ ID NO: 273) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Thompson-Snipes et al (1991) J. Exp. Med. 173, 507-510. inflammatory disorders immunologic disorders, cancer |
| Human Interleukin-1 beta precursor GeneSeq Accession R42447 EP569042 P01584/IL1B_HUMAN Interleukin-1 beta (SEQ ID NO: 274) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; Kitamura et al (1989) J Cell Physiol. 140 323-334. inflammatory disorders immunologic disorders, cancer |
| Human interleukin-6 GeneSeq Accession R49041 WO9403492 P05231/IL6_HUMAN Interleukin-6 (SEQ ID NO: 270) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Aarden et al (1987) Eur. J. Immunol 17, 1411-16. inflammatory disorders immunologic disorders, cancer |
| Mutant Interleukin 6 S176R GeneSeq Accession R54990 WO9411402 S176R variant of wildtype IL-6 which has the sequence: P05231/IL6_HUMAN Interleukin-6 (SEQ ID NO: 270) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Aarden et al (1987) Eur. J. Immunol 17, 1411-16. inflammatory disorders immunologic disorders, cancer |
| Interleukin 6 GeneSeq Accession R55256 JP06145063 P05231/IL6_HUMAN | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity |

TABLE 2B-continued

Illustrative Proteins, Illustrative Peptides, and Illustrative Indications

| Protein/Peptide Illustrative Identifier Reference | Description/Illustrative Indication(s) |
|---|---|
| Interleukin-6 (SEQ ID NO: 270) | can be determined using assays known in the art: Matthews et al., in *Lymphokines and Interferens: A Practical Approach*, Clemens et al., eds, IRL Press, Washington, D.C. 1987, pp. 221-225; and Aarden et al (1987) Eur. J. Immunol 17, 1411-16. inflammatory disorders immunologic disorders, cancer |
| Interleukin 8 (IL-8) receptor GeneSeq Accession R53932 JP06100595 GenBank: AAA59159.1 (SEQ ID NO: 275) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Holmes et al (1991) Science 253, 1278-80. Soluble IL-8 receptor polypeptides may be useful for inhibiting interleukin activities. |
| Human interleukin-7 GeneSeq Accession R59919 U.S. Pat. No. 5,328,988 P13232/IL7_HUMAN Interleukin-7 (isoform 1) (SEQ ID NO: 276) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Park et al (1990) J. Exp. Med. 171, 1073-79. inflammatory disorders immunologic disorders, cancer |
| IL-3 containing fusion protein. GeneSeq Accession R79342 and R79344 WO9521254 Fusions of wildtype IL-3 which has the sequence: P08700|IL3_HUMAN Interleukin-3 (SEQ ID NO: 449) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; Kitamura et al (1989) J Cell Physiol. 140 323-334. inflammatory disorders immunologic disorders, cancer |
| IL-3 mutant proteins GeneSeq Accession R79254, R79255, R79256, R79257, R79258, R79259, R79260, R79261, R79262, R79263, R79264, R79265, R79266, R79267, R79268, R79269, R79270, R79271, R79272, R79273, R79274, R79275, R79276, R79277, R79278, R79279, R79280, R79281, R79282, R79283, R79284, and R79285 ZA9402636 Variants of wildtype IL-3 which has the sequence: P08700|IL3_HUMAN Interleukin-3 (SEQ ID NO: 449) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Giri et al (1994) EMBO J. 13 2822-2830. inflammatory disorders immunologic disorders, cancer |
| IL-12 p40 subunit. GeneSeq Accession R63018 AU9466072 P2946/|IL12B_HUMAN Interleukin-12 subunit beta (SEQ ID NO: 277) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| AGF GeneSeq Accession R64240 WO9429344 Q8NI99/ANGL6_HUMAN Angiopoietin-related protein 6 (SEQ ID NO: 278) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| Human interlaukin-12 40 kD subunit GeneSeq Accession R79187 WO9519786 P2946/|IL12B_HUMAN Interleukin-12 subunit beta (SEQ ID NO: 277) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Hori et al (1987), Blood 70, 1069-1078. inflammatory disorders immunologic disorders, cancer |
| Human interleukin-15 receptor from clone P1 GeneSeq Accession R90843 WO9530695 | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity |

TABLE 2B-continued

Illustrative Proteins, Illustrative Peptides, and Illustrative Indications

| Protein/Peptide Illustrative Identifier Reference | Description/Illustrative Indication(s) |
|---|---|
| Q13261\|IL5RA_HUMAN Interleukin-15 receptor subunit alpha Isoform 1) (SEQ ID NO: 453) | can be determined using assays known in the art: Matthews et al., in *Lymphokines and Interferens: A Practical Approach*, Clemens et al., eds, IRL Press, Washington, D.C. 1987, pp. 221-225; and Giri et al (1994) EMBO J. 13 2822-2830. Soluble IL-8 receptor polypeptides may be useful for inhibiting interleukin activities. Obesity. Metabolic Disease. Diabetes. Enhancing secretion and stability of Interleukin 15 |
| Human interleukin-7 GeneSeq Accession R92796 WO9604306 P13232/IL7_HUMAN Interleukin-7 (isoform 1) (SEQ ID NO: 276) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Park et al (1990) J. Exp. Med. 171, 1073-79. inflammatory disorders immunologic disorders, cancer |
| interleukin-9 GeneSeq Accession R92797 WO9604306 P15248/IL9_HUMAN Interleukin-9 (SEQ ID NO: 279) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yang et al (1989) Blood 74, 1880-84. inflammatory disorders immunologic disorders, cancer |
| interleukin-3 GeneSeq Accession R92801 WO9604306 P08700\|IL3_HUMAN Interleukin-3 (SEQ ID NO: 280) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; Kitamura et al (1989) J Cell Physiol. 140 323-334. inflammatory disorders immunologic disorders, cancer |
| Human interleukin-5 GeneSeq Accession R92802 WO9604306 P05113/IL5_HUMAN Interleukin-5 (SEQ ID NO: 281) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; Kitamura et al (1989) J Cell Physiol. 140 323-334. inflammatory disorders immunologic disorders, cancer |
| Recombinant interleukin-16 GeneSeq Accession W33373 DE19617202 Q14005/IL16_HUMAN Pro-interleukin-16 (isoform 1) (SEQ ID NO: 282) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Lim et al (1996) J. Immunol. 156, 2566-70. inflammatory disorders immunologic disorders, cancer |
| Human IL-16 protein GeneSeq Accession W33234 DE19617202 Q14005/IL16_HUMAN Pro-interleukin-16 (isoform 1) (SEQ ID NO: 282) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Lim et al (1996) J. Immunol. 156, 2566-70. inflammatory disorders immunologic disorders, cancer |
| Thrl 17 human interleukin 9 GeneSeq Accession W27521 WO9708321 P15248\|IL9_HUMAN Interleukin-9 (SEQ ID NO: 387) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| Metl 17 human interleukin 9 GeneSeq Accession W27522 WO9708321 (SEQ ID NO: 388) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yang et al (1989) Blood 74, 1880-84. inflammatory disorders immunologic disorders, cancer |
| Human intracellular IL-1 receptor antagonist. GeneSeq Accession W77158 EP864585 (e.g. | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity |

TABLE 2B-continued

Illustrative Proteins, Illustrative Peptides, and Illustrative Indications

| Protein/Peptide Illustrative Identifier Reference | Description/Illustrative Indication(s) |
|---|---|
| SEQ ID NOs: 12 to 19, or 22 to 25 of this publication). | can be determined using assays known in the art: Matthews et al., in *Lymphokines and Interferens: A Practical Approach*, Clemens et al., eds, IRL Press, Washington, D.C. 1987, pp. 221-225; and Orencole & Dinarello (1989) Cytokine 1, 14-20. inflammatory disorders immunologic disorders, cancer |
| Human interleukin-18 protein (IL-18) GeneSeq Accession W77158 EP864585 Q14116/IL18_HUMAN Interleukin-18 (isoform 1) (SEQ ID NO: 283) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and USHIO et al (1996) J. Immunol. 156, 4274-79. inflammatory disorders immunologic disorders, cancer |
| Human interleukin-18 GeneSeq Accession W77077 EP861663 Q14116/IL18_HUMAN Interleukin-18 (isoform 1) (SEQ ID NO: 283) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and USHIO et al (1996) J. Immunol. 156, 4274-79. inflammatory disorders immunologic disorders, cancer |
| Human interleukin 18 derivatives GeneSeq Accessions W77083, W77084, W77085, W77086, W77087, W77088, and W77089 EP861663 Variants of wildtype IL18 which is provided as: Q14116/IL18_HUMAN Interleukin-18 (isoform 1) (SEQ ID NO: 283) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Ushio et al (1996) J. Immunol, 156, 4274-79. inflammatory disorders immunologic disorders, cancer |
| Interleukin-9 (IL-9) mature protein (Thr117 version). GeneSeq Accession W68158 WO9827997 FIG. 2 of WO9827997 (SEQ ID NO: 389) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yang et al (1989) Blood 74, 1880-84. inflammatory disorders immunologic disorders, cancer |
| IL-9 mature protein variant (Met117 version) GenSeq Accession W68157 WO9827997 FIG. 3 of WO9827997 (SEQ ID NO: 390) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yang et al (1989) Blood 74, 1880-84. inflammatory disorders immunologic disorders, cancer |
| Human IL-9 receptor protein variant #3. GeneSeq Accession W64058 WO9824904 Wildtype IL-9R is provided as: Q01113/IL9R_HUMAN Interleukin-9 receptor (isoform 1) (SEQ ID NO: 303) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yang et al (1989) Blood 74, 1880-84. inflammatory disorders immunologic disorders, cancer |
| Human IL-9 receptor protein variant fragment GenSeq Accession W64060 WO9824904 Wildtype IL-9R is provided as: Q01113/IL9R_HUMAN Interleukin-9 receptor (isoform 1) (SEQ ID NO: 303) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yang et al (1989) Blood 74, 1880-84. Soluble IL-9 receptor polypeptides may be useful for inhibiting interleukin activities. |
| Human IL-9 receptor protein variant #3. GeneSeq Accession | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis |

TABLE 2B-continued

Illustrative Proteins, Illustrative Peptides, and Illustrative Indications

| Protein/Peptide Illustrative Identifier Reference | Description/Illustrative Indication(s) |
|---|---|
| W64061 WO9824904 Wildtype IL-9R is provided as: Q01113/IL9R_HUMAN Interleukin-9 receptor (isoform 1) (SEQ ID NO: 303) | of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yang et al (1989) Blood 74, 1880-84. Soluble IL-9 receptor polypeptides may be useful for inhibiting interleukin activities. |
| Human Interleukin-12 p40 protein GeneSeq Accession W51311 WO9817689 P2946/IL12B_HUMAN Interleukin-12 subunit beta (SEQ ID NO: 277) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Hori et al (1987), Blood 70, 1069-1078. inflammatory disorders immunologic disorders, cancer |
| Human Interleukin-12 p35 protein GeneSeq Accession W51312 WO9817689 P29459/IL12A_HUMAN Interleukin-12 subunit alpha (SEQ ID NO: 284) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Hori et al (1987), Blood 70, 1069-1078. inflammatory disorders immunologic disorders, cancer |
| Human protein with IL-16 activity GeneSeq Accession W63753 DE19649233- | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Lim et al (1996) J. Immunol. 156, 2566-70. inflammatory disorders immunologic disorders, cancer |
| Human protein with IL-16 activity GeneSeq Accession W59425 DE19649233- | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Lim et al (1996) J. Immunol. 156, 2566-70. inflammatory disorders immunologic disorders, cancer |
| Human interleukin-15 GeneSeq Accession W53878 U.S. Pat. No. 5,747,024 P40933/IL15_HUMAN Interleukin-15 (isoform IL15-S48AA) (SEQ ID NO: 285) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Giri et al (1994) EMBO J. 13 2822-2830. inflammatory disorders immunologic disorders, cancer. Obesity. Metabolic Disease. Diabetes. |
| Human wild-type interleukin-4 (hIL-4) protein GeneSeq Accession W52149 WO9747744 P05112/IL4_HUMAN Interleukin-4 (isoform 1) (SEQ ID NO: 286) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Siegel & Mostowski (1990) J Immunol Methods 132, 287-295. inflammatory disorders immunologic disorders, cancer |
| interleukin-4 muteins GeneSeq Accessions W52150, W52151, W52153, W52154, W52155, W52156, W52157, W52158, W52159, W52160, W52161, W52162, W52163, W52164, W52165, W52166, and W52167 WO9747744 Variants of wildtype IL-4 which has the sequence: P05112/IL4_HUMAN Interleukin-4 (isoform 1) (SEQ ID NO: 268) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Siegel & Mostowski (1990) J Immunol Methods 132, 287-295. inflammatory disorders immunologic disorders, cancer |

TABLE 2B-continued

Illustrative Proteins, Illustrative Peptides, and Illustrative Indications

| Protein/Peptide Illustrative Identifier Reference | Description/Illustrative Indication(s) |
|---|---|
| Human interleukin 1 delta GeneSeq Accession Y28408 WO9935268 SEQ ID NO: 4 of WO9935268 (SEQ ID NO: 287) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarello (1989) Cytokine 1, 14-20. inflammatory disorders immunologic disorders, cancer |
| Human interleukin-1 receptor antagonist beta GeneSeq Accession Y24395 WO9935268 | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarello (1989) Cytokine 1, 14-20. inflammatory disorders immunologic disorders, cancer |
| Human EDIRF II protein sequence GeneSeq Accession Y22199 WO9932632 SEQ ID NO: 6 of WO9932632 (SEQ ID NO: 391) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| Human EDIRF I protein sequence GeneSeq Accession Y22197 WO9932632 SEQ ID NO: 2 of WO9932632 (SEQ ID NO: 392) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| Human IL- 1RD10 protein sequence GeneSeq Accession Y14131 WO9919480 SEQ ID NO: 20 of WO9919480 | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarello (1989) Cytokine 1, 14-20. Soluble IL-1RD10 receptor polypep- tides may be useful for inhibiting interleukin activites. |
| Human IL- 1RD9 GeneSeq Accession Y14122 WO9919480 SEQ ID NOS: 6, 8, 10 of WO9919480 | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarello (1989) Cytokine 1, 14-20. Soluble IL-1RD10 receptor polypep- tides may be useful for inhibiting interleukin activites. |
| Human DNAX interleukin- 40 GeneSeq Accession Y09196 WO9919491 SEQ ID NO: 2 or 4 of WO9919491 (SEQ ID NO: 454) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| (DIL-40) alternative sequence GeneSeq Accession Y09197 WO9919491 SEQ ID NO: 4 of WO9919491 (SEQ ID NO: 455) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| IL-11 GeneSeq Accession R50176 WO9405318 P2080/IL11_HUMAN Interleukin-11 (isoform 1) (SEQ ID NO: 288) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Lu et al (1994) J immunol. Methods 173, 19. inflammatory disorders immunologic disorders, cancer |
| Human adipogenesis inhibitory factor GeneSeq Accession R43260 | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis |

TABLE 2B-continued

Illustrative Proteins, Illustrative Peptides, and Illustrative Indications

| Protein/Peptide Illustrative Identifier Reference | Description/Illustrative Indication(s) |
|---|---|
| EP566410 (also known as IL-11) P2080/IL11_HUMAN Interleukin-11 (isoform 1) (SEQ ID NO: 288) | of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| IL-11 GeneSeq Accession W02202 JP08127539 P2080/IL11_HUMAN Interleukin-11 (isoform 1) (SEQ ID NO: 288) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Lu et al (1994) J immunol. Methods 173, 19. inflammatory disorders immunologic disorders, cancer |
| IL-14 GeneSeq Accession R55800 WO9416074 P40222/TXLNA_HUMAN Alpha-taxilin (SEQ ID NO: 289) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Ambrus et al (1993) PNAS 90, 63330-34. inflammatory disorders immunologic disorders, cancer |
| IL-17 receptor GeneSeq Accession B03807 U.S. Pat. No. 6,072,033 Q96F46/I17RA_HUMAN Interleukin-17 receptor A (SEQ ID NO: 290) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yao et al (1995) J. Immunol. 155, 5483-86. Soluble IL-17 receptor polypep- tides may be useful for inhibiting interleukin activites. |
| IL-17 GeneSeq Accession R76573 WO9518826 Q16552/IL17_HUMAN Interleukin-17A (SEQ ID NO: 291) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yao et al (1995) J. Immunol. 155, 5483-86. inflammatory disorders immunologic disorders, cancer |
| CTLA-8 GeneSeq Accession W13651 WO9704097 (also known as IL-17) Q16552/IL17_HUMAN Interleukin-17A (SEQ ID NO: 291) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. inflammatory disorders immunologic disorders, cancer |
| IL-19 GeneSeq Accession W37935 WO9808870 Q9UHD0|IL19_HUMAN Interleukin-19 (isoform 1) (SEQ ID NO: 292) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Gallagher et al (2000) Genes Immun. 1,442-50. inflammatory disorders immunologic disorders, cancer |
| IL-21 (TIF) GeneSeq Accession Y92879 WO0024758 Q9HBE4/IL21_HUMAN Interleukin-21 (isoform 1) (SEQ ID NO: 293) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Parrish-Novak et al (2000) Nature 408, 57-63. inflammatory disorders immunologic disorders, cancer |
| IL-8 receptor GeneSeq Accession R33420 WO9306229 IL-8RA P25024/CXCR1_HUMAN C-X-C chemokine receptor type 1 (SEQ ID NO: 294) IL-8RB P25025/CXCR2_HUMAN C-X-C chemokine receptor type 2 (SEQ ID NO: 295) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Holmes et al (1991) Science 253, 1278-80. Soluble IL-8 receptor polypep- tides may be useful for inhibiting interleukin activities. |

TABLE 2B-continued

Illustrative Proteins, Illustrative Peptides, and Illustrative Indications

| Protein/Peptide Illustrative Identifier Reference | Description/Illustrative Indication(s) |
|---|---|
| Human type II interleukin-1 receptor GeneSeq Accession R85480 U.S. Pat. No. 5,464,937 P27930/IL1R2_HUMAN Interleukin-1 receptor type 2 (SEQ ID NO: 296) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarello (1989) Cytokine 1, 14-20. Soluble type II interleukin-1 receptor polypep-tides may be useful for inhibiting interleukin activities. |
| Human interleukin-12 receptor GeneSeq Accession R69632 EP638644 IL-12 receptor B1 P42701\|I12R1_HUMAN Interleukin-12 receptor subunit beta-1 (isoform 1) (SEQ ID NO: 393) IL-12 receptor B2 Q99665\|I12R2_HUMAN Interleukin-12 receptor subunit beta-2 (isoform 1) (SEQ ID NO: 394) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Hori et al (1987), Blood 70, 1069-1078. Soluble IL-12 receptor polypep-tides may be useful for inhibiting interleukin activities. |
| Interleukin 8 receptor B GeneSeq Accession R80758 U.S. Pat. No. 5,440,021 IL-8RB P25025/CXCR2_HUMAN C-X-C chemokine receptor type 2 (SEQ ID NO: 295) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Holmes et al (1991) Science 253, 1278-80. Soluble IL-8 receptor B polypep-tides may be useful for inhibiting interleukin activities. |
| Human IL-8 receptor protein hIL8RA GeneSeq Accession B09989 JP08103276 IL-8RA P25024/CXCR1_HUMAN C-X-C chemokine receptor type 1 (SEQ ID NO: 294) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Holmes et al (1991) Science 253, 1278-80. Soluble IL-8 receptor A polypep-tides may be useful for inhibiting interleukin activities. |
| Human IL-8 receptor protein hIL8R GeneSeq Accession B09990 JP08103276 IL-8RA P25024/CXCR1_HUMAN C-X-C chemokine receptor type 1 (SEQ ID NO: 294) IL-8RB P25025/CXCR2_HUMAN C-X-C chemokine receptor type 2 (SEQ ID NO: 295) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Holmes et al (1991) Science 253, 1278-80. Soluble IL-8 receptor polypep-tides may be useful for inhibiting interleukin activities. |
| Interleukin-2 receptor associated protein p43 GeneSeq Accession R97569 WO9621732-SEQ ID NO: 2 of WO9621732 (SEQ ID NO: 395) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferons: A Practical Approach*, Clemens et al., eds, IRL Press, Washington, D.C. 1987, pp. 221-225; and Gillis et al (1978) J. Immunol. 120, 2027. Soluble IL-2 receptor polypep-tides may be useful for inhibiting interleukin activities. |
| Human interleukin-17 receptor GeneSeq Accession W04185 WO9629408 Q96F46/I17RA_HUMAN Interleukin-17 receptor A (SEQ ID NO: 290) | Interleukins are a group of multi-functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yao et al (1995) J. Immunol. 155, 5483-86. Soluble IL-17 receptor polypep-tides may be useful for inhibiting interleukin activities. |

TABLE 2B-continued

Illustrative Proteins, Illustrative Peptides, and Illustrative Indications

| Protein/Peptide Illustrative Identifier Reference | Description/Illustrative Indication(s) |
|---|---|
| Human interleukin-11 receptor GeneSeq Accession R99090 WO9619574 Q14626/I11RA_HUMAN Interleukin-11 receptor subunit alpha (SEQ ID NO: 297) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Lu et al (1994) J immunol. Methods 173, 19. Soluble IL-11 receptor polypep- tides may be useful for inhibiting interleukin activities. |
| Human interleukin-1 receptor accessory protein GeneSeq Accession W01911 WO9623067 Human IL1R Acp SEQ ID NO: 3 of WO9623067 (SEQ ID NO: 396) Soluble Human IL1R Acp SEQ ID NO: 9 of WO9623067 (SEQ ID NO: 397) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarello (1989) Cytokine 1, 14-20. Inflammatory disorders immunologic disorders, cancer |
| AGF Protein GeneSeq Accession R92749 U.S. Pat. No. 5,488,032 Q8NI99/ANGL6_HUMAN Angiopoietin-related protein 6 (SEQ ID NO: 278) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. Inflammatory disorders immunologic disorders, cancer |
| Human interleukin-1 type-3 receptor GeneSeq Accession R91064 W09607739 SEQ ID NO: 2 and 4 of WO9607739 (SEQ ID NO: 398 and SEQ ID NO: 399, respectively) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Orencole & Dinarello (1989) Cytokine 1, 14-20. Soluble IL-type-3 receptor polypep- tides may be useful for inhibiting interleukin activities |
| Human interleukin-13 beta receptor GeneSeq Accession W24972 WO9720926 SEQ ID NO: 2 from WO9720926 (SEQ ID NO: 400) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Boutelier et al (1995) J. Immunol. Methods 181, 29. Soluble IL-13 beta receptor polypep- tides may be useful for inhibiting interleukin activities. |
| Human interleukin-13 alpha receptor GeneSeq Accession W24973 WO9720926 IL-13RA1 P78552/I13R1_HUMAN Interleukin-13 receptor subunit alpha-1 (isoform 1) (SEQ ID NO: 298) IL-13RA2 Q14627/I13R2_HUMAN Interleukin-13 receptor subunit alpha-2 (SEQ ID NO: 299) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Boutelier et al (1995) J. Immunol. Methods 181, 29. Soluble IL-13 alpha receptor polypep- tides may be useful for inhibiting interleukin activities. |
| Human interleukin-4 receptor GeneSeq Accession W13499 U.S. Pat. No. 5,599,905 P24394/IL4RA_HUMAN Interleukin-4 receptor subunit alpha (isoform 1) (SEQ ID NO: 300) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Siegel & Mostowski (1990) J Immunol Methods 132, 287-295. Soluble IL-4 receptor polypep- tides may be useful for inhibiting interleukin activities. |
| Human interleukin-12 beta-2 receptor GeneSeq Accession W12771 EP759466 | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity |

TABLE 2B-continued

Illustrative Proteins, Illustrative Peptides, and Illustrative Indications

| Protein/Peptide Illustrative Identifier Reference | Description/Illustrative Indication(s) |
|---|---|
| Q9966/I12R2_HUMAN Interleukin-12 receptor subunit beta-2 (isoform 1) (SEQ ID NO: 301) | can be determined using assays known in the art: Matthews et al., in *Lymphokines and Interferens: A Practical Approach*, Clemens et al., eds, IRL Press, Washington, D.C. 1987, pp. 221-225; and Hori et al (1987), Blood 70, 1069-1078. Soluble IL-12 beta-2 receptor polypep- tides may be useful for inhibiting interleukin activities. |
| Human interleukin-12 beta-1 receptor. GeneSeq Accession W12772 EP759466 P4270/I12R1_HUMAN Interleukin-12 receptor subunit beta-1 (isoform 1) (SEQ ID NO: 302) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Hori et al (1987), Blood 70, 1069-1078. Soluble IL-12 beta-1 receptor polypep- tides may be useful for inhibiting interleukin activities. |
| Human IL-9 receptor protein GeneSeq Accessions W64055, W64056, and W64057 WO9824904 Q01113/IL9R_HUMAN Interleukin-9 receptor (isoform 1) (SEQ ID NO: 303) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yang et al (1989) Blood 74, 1880-84. Soluble IL-9 receptor polypep- tides may be useful for inhibiting interleukin activities. |
| IL-10 receptor GeneSeq Accession W41804 U.S. Pat. No. 5,716,804 IL-10RA Q13651/I10R1_HUMAN Interleukin-10 receptor subunit alpha (SEQ ID NO: 304) IL-10RB Q0833/I10R2_HUMAN Interleukin-10 receptor subunit beta (SEQ ID NO: 305) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Thompson-Snipes et al (1991) J. Exp. Med. 173, 507-510. Soluble IL-10 receptor polypep- tides may be useful for inhibiting interleukin activities. |
| Human IL-6 receptor GeneSeq Accession Y30938 JP11196867 P08887/IL6RA_HUMAN Interleukin-6 receptor subunit alpha (isoform 1) (SEQ ID NO: 306) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Aarden et al (1987) Eur. J. Immunol 17, 1411-16. Soluble IL-6 receptor polypep- tides may be useful for inhibiting interleukin activities. |
| Il-17 receptor GeneSeq Accession Y97181 U.S. Pat. No. 6,096,305 Q96F46/I17RA_HUMAN Interleukin-17 receptor A (SEQ ID NO: 290) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yao et al (1995) J. Immunol. 155, 5483-86. Soluble IL-17 receptor polypep- tides may be useful for inhibiting interleukin activities. |
| Il-17 receptor GeneSeq Accession Y97131 U.S. Pat. No. 6,100,235 Q96F46/I17RA_HUMAN Interleukin-17 receptor A (SEQ ID NO: 290) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Yao et al (1995) J. Immunol. 155, 5483-86. Soluble IL-17 receptor polypep- tides may be useful for inhibiting interleukin activities. |
| Human interleukin-3 receptor GeneSeq Accession R25300 EP509826 P26951/IL3RA_HUMAN Interleukin-3 receptor subunit alpha (isoform 1) (SEQ ID NO: 307) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; Kitamura et al (1989) J Cell Physiol. 140 323-334. Soluble IL-3 receptor polypep- tides may be useful for inhibiting interleukin activities. |
| Human GM- CSF receptor GeneSeq Accession R10919 WO9102063 GM-CSF receptor A P15509/CSF2R_HUMAN | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines* |

TABLE 2B-continued

Illustrative Proteins, Illustrative Peptides, and Illustrative Indications

| Protein/Peptide Illustrative Identifier Reference | Description/Illustrative Indication(s) |
|---|---|
| Granulocyte-macrophage colony-stimulating factor receptor subunit alpha (isoform 1) (SEQ ID NO: 308) GM-CSF receptor B P32927/IL3RB_HUMAN Cytokine receptor common subunit beta (isoform 1) (SEQ ID NO: 309) | and Interferens: A Practical Approach, Clemens et al., eds, IRL Press, Washington, D.C. 1987, pp. 221-225. Soluble GM-CSF receptor polypep- tides may be useful for inhibiting interleukin activities. |
| Human IL-5 receptor alpha chain GeneSeq Accession R25064 EP492214 Q01344/IL5RA_HUMAN Interleukin-5 receptor subunit alpha (isoform 1) (SEQ ID NO: 310) Il-5 receptor GeneSeq Accession W82842 WO9847923 Q01344/IL5RA_HUMAN Interleukin-5 receptor subunit alpha (isoform 1) (SEQ ID NO: 310) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; Kitamura et al (1989) J Cell Physiol. 140 323-334. Soluble IL-5 receptor alpha polypeptides may be useful for inhibiting interleukin activities. Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; Kitamura et al (1989) J Cell Physiol. 140 323-334. Soluble IL-5 receptor polypep- tides may be useful for inhibiting interleukin activities. |
| Il-6 receptor GeneSeq Accession R37215 JP05091892 P08887/IL6RA_HUMAN Interleukin-6 receptor subunit alpha (isoform 1) (SEQ ID NO: 306) Human B cell stimulating factor-2 receptor GeneSeq Accession P90525 AU8928720 P08887/IL6RA HUMAN Interleukin-6 receptor subunit alpha (isoform 1) (SEQ ID NO: 306) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Aarden et al (1987) Eur. J. Immunol 17, 1411-16. Soluble IL-6 receptor polypep- tides may be useful for inhibiting interleukin activities. Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225. Soluble B cell stimulating factor-2 receptor polypep- tides may be useful for inhibiting interleukin activities. |
| IL-7 receptor clone GeneSeq Accession R08330 EP403114 P1687/IL7RA_HUMAN Interleukin-7 receptor subunit alpha (isoform 1) (SEQ ID NO: 311) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Park et al (1990) J. Exp. Med. 171, 1073-79. Soluble IL-7 receptor polypep- tides may be useful for inhibiting interleukin activities. |
| EPO receptor; EPOR GeneSeq Accession R06512 WO9008822 P19235/EPOR_HUMAN Erythropoietin receptor (isoform EPOR-F) (SEQ ID NO: 312) | EPO Receptor is involved in the proliferation and differentiation of erythroblasts. EPO Receptor activity can be determined using assays known in the art, such as, J Biol Chem 2001 Mar. 23; 276(12: 8995-9002; JAK2 protein tyrosine kinase activity: Blood 1994 Sep. 1; 84(5): 1501-7 and Mol Cell Biol. 1994 October; 14(10: 6506-14. Inflammatory disorders, immunologic disorders, cancer, erythroblast proliferation and differentiation |
| IL-15 receptor GeneSeq Accession R90843 WO9530695 Q1326/Il15RA_HUMAN Interleukin-15 receptor subunit alpha (isoform 1) (SEQ ID NO: 313) | Interleukins are a group of multi- functional cytokines synthesized by lymphocytes, monocytes, and macrophages. Known functions include stimulating proliferation of immune cells (e.g., T helper cells, B cells, eosinophils, and lymphocytes), chemotaxis of neutrophils and T lymphocytes, and/or inhibition of interferons. Interleukin activity can be determined using assays known in the art: Matthews et al., in *Lymphokines and Interferens: A Practical Approach*, Clemens et al., eds, IRL Press, Washington, D.C. 1987, pp. 221-225; and Giri et al (1994) EMBO J. 13 2822-2830. Soluble IL-15 receptor polypep- tides may be useful for inhibiting interleukin activities. Obesity. Metabolic Disease. Diabetes. Enhancing secretion and stability of Interleukin 15 |
| CD137; 4-1BB Receptor Protein GeneSeq Accession R70977 | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, |

TABLE 2B-continued

Illustrative Proteins, Illustrative Peptides, and Illustrative Indications

| Protein/Peptide Illustrative Identifier Reference | Description/Illustrative Indication(s) |
|---|---|
| WO9507984 Q07011/TNR9_HUMAN Tumor necrosis factor receptor superfamily member 9 (SEQ ID NO: 314) | Science, 285(5425): 260-3; Song H Y et al., 1997 Proc Natl Acad Sci USA 94(18): 9792-6; Epsevik and Nissen-Meyer, 1986, J. Immunol. Methods. Soluble 4-1BB receptor polypeptides may be useful for inhibiting apoptosis, NF-kB activation, and/or co-stimulation of immune cells such as B and T cells. |
| BCMA GeneSeq Accession Y71979 WO0068378 Q02223/TNR17_HUMAN Tumor necrosis factor receptor superfamily member 17 (isoform 1) (SEQ ID NO: 315) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Soluble BCMA receptor polypeptides may be useful for inhibiting apoptosis, NF-kB activation, and/or co-stimulation of immune cells such as B and T cells. |
| CD27 GeneSeq Accession R20814 WO9201049 P26842/CD27_HUMAN CD27 antigen (SEQ ID NO: 316) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Soluble CD27 polypeptides may be useful for inhibiting apoptosis, NF-kB activation, and/or co-stimulation of immune cells such as B and T cells. |
| CD30 GeneSeq Accession R35478 DE4200043 P28908/TNR8_HUMAN Tumor necrosis factor receptor superfamily member 8 (isoform 1) (SEQ ID NO: 317) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792- 6; Epsevik and Nissen-Meyer, 1986, J. Immunol. Methods. Soluble CD30 polypeptides may be useful for inhibiting apoptosis, NF-kB activation, and/or co-stimulation of immune cells such as B and T cells. |
| CD40 GeneSeq Accession Y33499 WO9945944 P25942/TNR5_HUMAN Tumor necrosis factor receptor superfamily member 5 (isoform 1) (SEQ ID NO: 318) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Soluble CD40 polypeptides may be useful for inhibiting apoptosis, NF-kB activation, and/or co-stimulation of immune cells such as B and T cells. |
| EDAR Genbank Accession AAD50077 Q9UNE0|EDAR_HUMAN Tumor necrosis factor receptor superfamily member EDAR (isoform 1) (SEQ ID NO: 319) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Immune Disorders, Lymphomas, X-linked hypohidrotic ectodermal dysplasia |
| OX40; ACT-4 GeneSeq Accession R74737 WO9512673 P43489/TNR4_HUMAN Tumor necrosis factor receptor superfamily member 4 (SEQ ID NO: 320) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Immune Disorders, Lymphomas, T cell disorders |
| TACI GeneSeq Accession W75783 WO9839361 O14836/TR13B_HUMAN Tumor necrosis factor receptor superfamily member 13B (isoform 1) (SEQ ID NO: 321) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Soluble TACI receptor polypeptides may be useful for inhibiting apoptosis, NF-kB activation, and/or co-stimulation of immune cells such as B and T cells. |
| TNF-R GeneSeq Accession R10986 AU9058976 P19438/TNR1A_HUMAN Tumor necrosis factor receptor superfamily member 1A (isoform 1) (SEQ ID NO: 322) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Soluble TNF-R receptor polypeptides may be useful for inhibiting apoptosis, NF-kB activation, and/or co-stimulation of immune cells such as B and T cells. |
| TNF-RII; TNF p75 receptor; Death Receptor GeneSeq Accession | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, |

TABLE 2B-continued

Illustrative Proteins, Illustrative Peptides, and Illustrative Indications

| Protein/Peptide Illustrative Identifier Reference | Description/Illustrative Indication(s) |
|---|---|
| R11141 EP418014 P20333/TNR1B_HUMAN Tumor necrosis factor receptor superfamily member 1B (isoform 1) (SEQ ID NO: 323) | Science, 285(5425): 260-3; Song H Y et al., 1997 Proc Natl Acad Sci USA 94(18): 9792-6; Epsevik and Nissen-Meyer, 1986, J. Immunol. Methods. Soluble TNFR-II receptor polypeptides may be useful for inhibiting apoptosis, NF-kB activation, and/or co-stimulation of immune cells such as B and T cells. |
| hAPO-4; TROY GeneSeq Accession W93581 WO9911791 Q9N568/TNR19_HUMAN Tumor necrosis factor receptor superfamily member 19 (isoform 1) (SEQ ID NO: 324) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Immune Disorders, Cancers |
| TNF-alpha precursor GeneSeq Accession P60074 EP205038 | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| Human TNF- alpha GeneSeq Accession R62463 EP619372 P01375/TNFA_HUMAN Tumor necrosis factor (SEQ ID NO: 325) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| Human TNF- alpha GeneSeq Accession R42679 EP563714 P01375/TNFA_HUMAN Tumor necrosis factor (SEQ ID NO: 325) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| Human TNF- beta (LT-alpha) GeneSeq Accession B37799 WO0064479 P01374/TNFB_HUMAN Lymphotoxin-alpha (SEQ ID NO: 326) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| LT-alpha GeneSeq Accession P70107 EP250000 P01374/TNFB_HUMAN Lymphotoxin-alpha (SEQ ID NO: 326) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| LT-beta GeneSeq Accession R56869 WO9413808 Q06643/TNFC_HUMAN Lymphotoxin-beta (isoform 1) (SEQ ID NO: 327) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| OPGL GeneSeq Accession W83195 WO9846751 O14788/TNF11_HUMAN Tumor necrosis factor ligand superfamily member 11 (isoform 1) (SEQ ID NO: 328) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer, loss of bone mass |
| FasL GeneSeq Accession W98071 WO9903999 P48023/TNFL6_HUMAN Tumor necrosis factor ligand superfamily member 6 (isoform 1) (SEQ ID NO: 329) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |

TABLE 2B-continued

Illustrative Proteins, Illustrative Peptides, and Illustrative Indications

| Protein/Peptide Illustrative Identifier Reference | Description/Illustrative Indication(s) |
|---|---|
| FasL GeneSeq Accession W95041 WO9903998 P48023/TNFL6__HUMAN Tumor necrosis factor ligand superfamily member 6 (isoform 1) (SEQ ID NO: 329) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| CD27L GeneSeq Accession R50121 WO9405691 P32970/CD70__HUMAN CD70 antigen (isoform 1) (SEQ ID NO: 330) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| CD30 ligand GeneSeq Accession R45007 WO9324135 P32971/TNFL8__HUMAN Tumor necrosis factor ligand superfamily member 8 (SEQ ID NO: 331) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| CD40L GeneSeq Accession R85486 WO9529935 P29965/CD40L__HUMAN CD40 ligand (SEQ ID NO: 332) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| 4-1BB ligand GeneSeq Accession W26657 U.S. Pat. No. 5,674,704 P41273/TNFL9__HUMAN Tumor necrosis factor ligand superfamily member 9 (SEQ ID NO: 333) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| FAS Ligand Inhibitory Protein (DcR3) GeneSeq Accession B19335 WO0058465 O95407/TNF6B__HUMAN Tumor necrosis factor receptor superfamily member 6B (SEQ ID NO: 334) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Soluble DcR3 polypeptides may be useful for inhibiting apoptosis, NF-kB activation, and/or co-stimulation of immune cells such as B and T cells. |
| OX40L GeneSeq Accession R79903 WO9521915 P23510/TNFL4__HUMAN Tumor necrosis factor ligand superfamily member 4 (isoform 1) (SEQ ID NO: 335) | Activities associated with apoptosis, NF-kB activation, and co- stimulation of immune cells such as T and B cells. Apoptosis activity, NF-kB activation, and B and T cell co-stimulation can be determined using assays known in the art: Moore et al., 1999, Science, 285(5425): 260-3; Song H Y et al., 1997 Proc Natl Acad Sci USA 94(18): 9792-6; Epsevik and Nissen-Meyer, 1986, J. Immunol. Methods. Inflammatory disorders immunologic disorders, cancer |
| Protease inhibitor peptides GeneSeq Accessions R12435, R12436, R12437, R12438, R12439, R12440, and R1244 WO9106561 | Peptides that inhibit the function/binding of HIV HIV protease activities are known in the art: HIV protease assays: EP0387231. One can modify the assay to look for inhibition using any of the disclosed protease inhibitor polypeptides. HIV, inflammatory disorders, immuno- logic disorders, cancer, viral infections |
| Retroviral protease inhibitors GeneSeq Accessions R06660, R06661, R06662, R06663, R06664, R06665, R06666, R06667, R06668, R06669, R06670, R06671, R06672, R06673, R06674, R06675, and R06676 EP387231 | Peptides that inhibit the function/binding of HIV HIV protease activities are known in the art: HIV protease assays: EP0387231. One can modify the assay to look for inhibition using any of the disclosed protease inhibitor polypeptides. HIV, inflammatory disorders, immuno- logic disorders, cancer, viral infections |
| HIV protease inhibiting peptides GeneSeq Accessions R59293, R59294, R59295, R59296, R59297, R59298, R59299, | Peptides that inhibit the function/binding of HIV HIV protease activities are known in the art: HIV protease assays: EP0387231. One can modify the assay to look for inhibition using any of the disclosed protease inhibitor polypeptides. HIV, inflammatory disorders, immuno- logic disorders, cancer, viral infections |

TABLE 2B-continued

Illustrative Proteins, Illustrative Peptides, and Illustrative Indications

| Protein/Peptide Illustrative Identifier Reference | Description/Illustrative Indication(s) |
|---|---|
| R592300, R59301, R59302, R59301, R59303, R59304, R59305, R59306, R59307, R59308, R59309, R59310, R59311, R59312, R59313, R59314, R59315, R59316, R59317 R59318, R59319, R59320, R59321, R59322, R59323, R59324, R59325, R59326, R59327, R59328, R59329, R59330, R59331, R59332, R59333, R59334, R59335, R59336, R59337, R59338, R59339, R59340, R59341, R59342, R59343, R59344, R59345, R59346, R59347, R59348, R59349, and R59350 WO9301828 | |
| HIV-1 protease inhibitors GeneSeq Accessions R86326, R86327, R86328, R86329, R86330, R86331, R86332, R86333, R86334, R86335, R86336, R86337, R86338, R86339, R86340, R86341, R86342, R86343, R86344, R86345, R86346, R86347, R86348, R86349, R86350, R86351, R86352, R86353, R86354, R86355, R86356, R86357, R86358, R86359, R86360, R86361, R86362, R86363, R86364, R86365, R86366, R86367, R86368, R86369, R86370, and R86371 DE4412174 | Peptides that inhibit the function/binding of HIV HIV protease activities are known in the art: HIV protease assays: EP0387231. One can modify the assay to look for inhibition using any of the disclosed protease inhibitor polypeptides. HIV, inflammatory disorders, immuno- logic disorders, cancer, viral infections |
| HIV Inhibitor Peptide GeneSeq Accession Y89687 WO9959615 | Peptides that inhibit the function/binding of HIV HIV protease activities are known in the art: HIV protease assays: EP0387231. One can modify the assay to look for inhibition using any of the disclosed protease inhibitor polypeptides. HIV, inflammatory disorders, immuno- logic disorders, cancer, viral infections |
| HIV Inhibitor Peptide GenSeq Accession Y31955 WO9948513 | Peptides that inhibit the function/binding of HIV HIV protease activities are known in the art: HIV protease assays: EP0387231. One can modify the assay to look for inhibition using any of the disclosed protease inhibitor polypeptides. HIV, inflammatory disorders, immuno- logic disorders, cancer, viral infections |
| HIV Inhibitor Peptide Science 291, 884 (2001); Published online 12 Jan. 2001; 10.1126/science.1057453 | Peptides that inhibit the function/binding of HIV HIV protease activities are known in the art: HIV protease assays: EP0387231. One can modify the assay to look for inhibition using any of the disclosed protease inhibitor polypeptides. HIV, inflammatory disorders, immuno- logic disorders, cancer, viral infections |
| Human monocyte chemoattractant factor hMCP-3 GeneSeq Accession R73915 WO9509232 P80098/CCL7_HUMAN C-C motif chemokine 7 (SEQ ID NO: 336) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, particularly useful for treating bacterial and/or viral menigitis |
| Human monocyte chemoattractant factor hMCP-1 GeneSeq Accession R73914 WO9509232 P13500/CCL2_HUMAN C-C motif chemokine 2 (SEQ ID NO: 337) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, particularly useful for treating bacterial and/or viral menigitis |
| Human gro-beta chemokine GeneSeq Accessions R66699 and | Chemokines are a family of related small, secreted proteins involved in biological processes ranging from hematopoiesis, angiogenesis, and leukocyte trafficking. Members of this family are involved in a similarly diverse range of pathologies |

TABLE 2B-continued

Illustrative Proteins, Illustrative Peptides, and Illustrative Indications

| Protein/Peptide Illustrative Identifier Reference | Description/Illustrative Indication(s) |
|---|---|
| W17671 WO9429341 P19875/CXCL2_HUMAN C-X-C motif chemokine 2 (SEQ ID NO: 338) | including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, inflammatory disorders, blood-related disorders, stem cell transplantation, cancer |
| Human gro-gamma chemokine GeneSeq Accessions R66700 and W17672 WO9429341 P19876/CXCL3_HUMAN C-X-C motif chemokine 3 (SEQ ID NO: 339) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, inflammatory disorders, blood-related disorders, stem cell transplantation, cancer |
| Human gro-alpha chemokine GeneSeq Accessions R66698 and W18024 WO9429341 P09341/GROA_HUMAN Growth-regulated alpha protein (SEQ ID NO: 340) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, inflammatory disorders, blood-related disorders, stem cell transplantation, cancer |
| Human eosinophil-expressed chemokine (EEC) GeneSeq Accession W05186 WO9632481 SEQ ID NO: 2 of WO9632481 (SEQ ID NO: 401) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, particularly treatment of eosinophilia, inflammation, allergies, asthma, leukaemia and lymphoma |
| Chemokine-like protein PF4-414 Full-Length and Mature GeneSeq Accessions R92318 and R99809 WO9613587 FIG. 3C of WO9613587 (SEQ ID NO: 402) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer and blood- related disorders, particularly myelosuppression |
| Chemokine-like protein IL-8M3 GeneSeq Accession R99812 WO9613587 | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ; and Holmes et al (1991) Science 253, 1278-80. Cancer and blood- related disorders, particularly myelosuppression |
| Human interleukin-8 (IL-8) GeneSeq Accession R99814 WO9613587 P10145/IL8_HUMAN Interleukin-8 (isoform 1) (SEQ ID NO: 341) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ; and Holmes et al (1991) Science 253, 1278-80. Cancer and blood- related disorders, particularly myelosuppression |

TABLE 2B-continued

Illustrative Proteins, Illustrative Peptides, and Illustrative Indications

Figure 4:
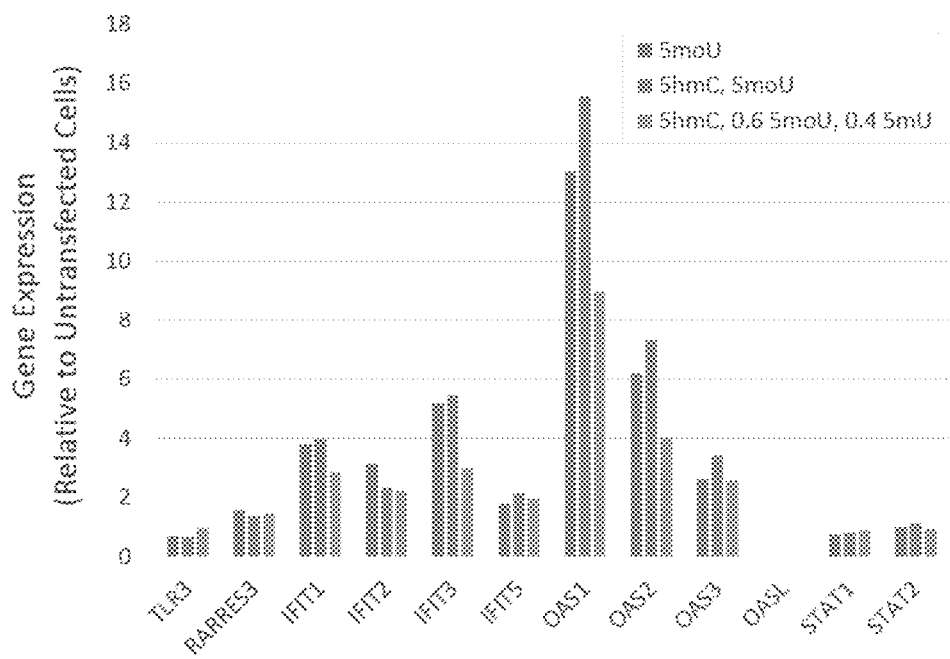

| Protein/Peptide Illustrative Identifier Reference | Description/Illustrative Indication(s) |
|---|---|
| Chemokine-like protein IL-8M1 Full-Length and Mature GeneSeq Accessions R99815 and R99803 WO9613587 FIG. 4B of WO9613587 (SEQ ID NO: 403) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ; and Holmes et al (1991) Science 253, 1278-80. Cancer and blood- related disorders, particularly myelosuppression |
| Chemokine-like protein IL-8M8 Full-Length and Mature GeneSeq Accessions R99816 and R99805 WO9613587 FIG. 4C of WO9613587 (SEQ ID NO: 404) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ; and Holmes et al (1991) Science 253, 1278-80. Cancer and blood- related disorders, particularly myelosuppression |
| Chemokine-like protein IL-8M8 Full-Length and Mature GeneSeq Accessions R99817 and R99806 WO9613587 FIG. 4C of WO9613587 (SEQ ID NO: 404) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ; and Holmes et al (1991) Science 253, 1278-80. Cancer and blood- related disorders, particularly myelosuppression. |
| Chemokine-like protein IL-8M8 Full-Length and Mature GeneSeq Accessions R99818 and R99804 WO9613587 FIG. 4C of WO9613587 (SEQ ID NO: 404) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ; and Holmes et al (1991) Science 253, 1278-80. Cancer and blood- related disorders, particularly myelosuppression. |
| Chemokine-like protein IL-8M8 Full-Length and Mature GeneSeq Accessions R99819 and R99807 WO9613587 FIG. 4C of WO9613587 (SEQ ID NO: 404) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer and blood- related disorders, particularly myelosuppression. |
| Chemokine-like protein IL-8M8 Full-Length and Mature GeneSeq Accessions R99822 and R9807 WO9613587 FIG. 4C of WO9613587 (SEQ ID NO: 404) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer and blood- related disorders, particularly myelosuppression. |
| Human foetal spleen expressed chemo-kine, FSEC GeneSeq Accession R98499 WO9622374 SEQ ID NO: 2 of WO9622374 (SEQ ID NO: 405) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: |

TABLE 2B-continued

Illustrative Proteins, Illustrative Peptides, and Illustrative Indications

| Protein/Peptide Illustrative Identifier Reference | Description/Illustrative Indication(s) |
|---|---|
| | Chemokine Protocols. Edited by: A. E. I. Proudfoot, T. N. C. Wells, and C. A. Power. Humana Press Inc., Totowa, NJ. Immune disorders |
| Liver expressed chemokine-1(LVEC-1) GeneSeq Accession R95689 WO9616979 SEQ ID NO: 2 of WO9616979 (SEQ ID NO: 406) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammation of the liver |
| Liver expressed chemokine-2(LVEC-2) GeneSeq Accession R95690 WO9616979 SEQ ID NO: 4 of WO9616979 (SEQ ID NO: 407) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammation of the liver |
| Pituitary expressed chemokine (PGEC) GeneSeq Accession R95691 WO9616979 SEQ ID NO: 6 of WO9616979 (SEQ ID NO: 408) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammation, particularly of the liver |
| Adenoid-expressed chemokine (ADEC) GeneSeq Accession R97664 WO9617868 SEQ ID NO: 2 of WO9617868 (SEQ ID NO: 409) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammation, angiogenesis, tumorigenesis, musculoskeletal disorders |
| Human chemokine CC-2 GeneSeq Accession W38170 WO9741230 Q16663/CCL15_HUMAN C-C motif chemokine 15 (SEQ ID NO: 342) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, cell migration, proliferation, and differentiation disorders |
| Human chemokine HCC-1 GeneSeq Accession W38171 WO9741230 Q16627/CCL14_HUMAN C-C motif chemokine 14 (SEQ ID NO: 343) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, cell migration, proliferation, and differentiation disorders |
| Human chemokine CC- 3 GeneSeq Accession W38172 WO9741230 Q16627/CCL14_HUMAN C-C motif chemokine 14 (SEQ ID NO: 343) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. |

TABLE 2B-continued

Illustrative Proteins, Illustrative Peptides, and Illustrative Indications

| Protein/Peptide Illustrative Identifier Reference | Description/Illustrative Indication(s) |
|---|---|
| | Humana Press Inc., Totowa, NJ. Immune disorders, cell migration, proliferation, and differentiation |
| Novel betachemokine designated PTEC GeneSeq Accession W27271 WO9739126 SEQ ID NO: 2 of WO9739126 (SEQ ID NO: 410) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, vascular disorders, cancer |
| Human CX3C 111 amino acid chemokine GeneSeq Accession W23344 WO9727299 SEQ ID NO: 2 of WO9727299 (SEQ ID NO: 411) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, inflammatory diseases, abnormal proliferation, regeneration, degeneration, and atrophy |
| Human CCF18 chemokine GeneSeq Accession W25942 WO9721812 SEQ ID NO: 4 of WO9721812 (SEQ ID NO: 412) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Abnormal physiology and development disorders, can also be used as an anti-viral agent |
| Human beta-chemokine H1305 (MCP-2) GeneSeq Accession W26655 WO9725427 P80075/CCL8_HUMAN C-C motif chemokine 8 (SEQ ID NO: 344) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Chemotaxis, blood-related disorders, viral infection, HIV, wound healing, cancer |
| Human eosinocyte CC type chemokine eotaxin GeneSeq Accession W14990 WO9712914 P51671/CCL11_HUMAN Eotaxin (SEQ ID NO: 245) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammatory and immune disorders |
| Human thymus and activation regulated cytokine (TARC) GeneSeq Accession W14018 WO9711969 Q92583/CCL17_HUMAN C-C motif chemokine 17 (SEQ ID NO: 261) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in molecular Biology, 2000, vol. 138: Chemokine Protocols, Edited by A. E. I. Proudfoot, T. N. C. Wells, and C. A. Power Humana Press Inc., Totowa, NJ Inflammatory and immune disorders |
| Human chemokine beta-8 short forms GeneSeq Accession W16315 WO9712041 Wildtype chemokine beta-8 provided as: P55773\|CCL23_HUMAN | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined |

TABLE 2B-continued

Illustrative Proteins, Illustrative Peptides, and Illustrative Indications

| Protein/Peptide Illustrative Identifier Reference | Description/Illustrative Indication(s) |
|---|---|
| C-C motif chemokine 23 (SEQ ID NO: 459) | using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer, wound healing, immune disorders |
| Microphage derived chemokine, MDC GeneSeq Accession W20058 WO9640923 O00626/CCL22_HUMAN C-C motif chemokine 22 (SEQ ID NO: 345) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammatory diseases, wound healin, angiogenesis |
| Human chemokine ZSIG-35 GeneSeq Accession W30565 WO9844117 SEQ ID NO: 2 of WO WO9844117 (SEQ ID NO: 413) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammatory and immune diseases |
| Primate CC chemokine "ILINCK" GeneSeq Accesssion W69990 WO98328658 SEQ ID NO: 4 from WO9832858 (SEQ ID NO: 414) | Chemokines are a family of related small, secreted proteins involved in biological processes ranging from hematopoiesis, angiogenesis, and leukocyte trafficking. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and inflammatory disorders, abnormal proliferation, regen- eration, generation and atrophy disorders |
| Primate CXC chemokine "IBICK" GeneSeq Accession W69989 WO9832858 SEQ ID NO: 2 from WO9832858 (SEQ ID NO: 415) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and inflammatory disorders, abnormal proliferation, regen- eration, generation and atrophy disorders |
| Human CC-type chemokine protein designated SLC (secondary lymphoid chemokine) GeneSeq Accession W69163 WO9831809 O00585/CCL21_HUMAN C-C motif chemokine 21 (SEQ ID NO: 346) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune, inflammatory, and infectious disorders, cancer |
| Human CC chemokine ELC protein GeneSeq Accession W62542 WO9826071 Q99731/CCL19_HUMAN C-C motif chemokine 19 (SEQ ID NO: 249) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer and infectious diseases, particularly herpes virus |
| Human DVic-1 C-C chemokine GeneSeq Accession W60649 WO9823750 SEQ ID NO: 2 of WO9823750 (SEQ ID NO: 416) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined |

TABLE 2B-continued

Illustrative Proteins, Illustrative Peptides, and Illustrative Indications

| Protein/Peptide Illustrative Identifier Reference | Description/Illustrative Indication(s) |
|---|---|
| | using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Abnormal prolifera- tion, regeneration, degeneration, and atrophy disorders, including cancer |
| Human C-C chemokine DGWCC GeneSeq Accession W60650 WO9823750 SEQ ID NO: 6 of WO9823750 (SEQ ID NO: 417) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, cell proliferation disorders, cancer |
| Human STCP-1 GeneSeq Accession W62783 WO9824907 O00626/CCL22__HUMAN C-C motif chemokine 22 (SEQ ID NO: 345) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, particularly T cell related disorders, viral infection, and inflammation, especially joint |
| Exodus protein GeneSeq Accession W61279 WO9821330 P78556/CCL20__HUMAN C-C motif chemokine 20 (isoform 1) (SEQ ID NO: 248) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and inflammatory disorders, angiogenesis, cancer, and proliferation disorders, particularly myeloproliferative diseases |
| Human Chr19kine protein GeneSeq Acession W50887 WO9814581 SEQ ID NO: 10 of WO9814581 (SEQ ID NO: 418) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer and de- generative disorders |
| Human T cell mixed lymphocyte reaction expressed chemokine (TMEC) GeneSeq Accession W58703 U.S. Pat. No. 5,780,268 SEQ ID NO: 2 of U.S. Pat. No. 5,780,268 (SEQ ID NO: 460) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune, inflammatory, and infectious disorders, cancer |
| Human 6CKine protein GeneSeq Accession W50885 W09814581 SEQ ID NO: 8 of WO9814581 (SEQ ID NO: 419) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer and de- generative disorders |
| human liver and activation regulated chemokine (LARC) GeneSeq | Chemokines are a family of related small, secreted proteins involved in biological processes ranging from hematopoiesis, angiogenesis, and leukocyte trafficking. Members of this family are involved in a similarly diverse range of pathologies |

TABLE 2B-continued

Illustrative Proteins, Illustrative Peptides, and Illustrative Indications

| Protein/Peptide Illustrative Identifier Reference | Description/Illustrative Indication(s) |
|---|---|
| Accession W57475 WO9817800 P78556/CCL20_HUMAN C-C motif chemokine 20 (isoform 1) (SEQ ID NO: 248) | including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune, inflammatory, and infectious disorders, cancer |
| RANTES peptide GeneSeq Accession W29538 WO9744462 Wildtype Rantes provided herien as P13501/CCL5_HUMAN C-C motif chemokine 5 (SEQ ID NO: 241) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Infectious diseases, particularly HIV |
| RANTES 8-68 GeneSeq Accession W29529 WO9744462 Wildtype Rantes provided herien as P13501/CCL5_HUMAN C-C motif chemokine 5 (SEQ ID NO: 241) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Infectious diseases, particularly HIV |
| RANTES 9-68 GeneSeq Accession W29528 WO9744462 Wildtype Rantes provided herien as P13501/CCL5_HUMAN C-C motif chemokine 5 (SEQ ID NO: 241) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Infectious diseases, particularly HIV |
| Human chemokine protein 331D5 GeneSeq Accession W59433 WO9811226 SEQ ID NO: 12 of WO9811226 (SEQ ID NO: 420) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Abnormal prolifera- tion, regeneration, degeneration, or atrophy, including cancer |
| Human chemokine protein 61164 GeneSeq Accession W59430 WO9811226 SEQ ID NO: 6 of WO9811226 (SEQ ID NO: 421) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Abnormal prolifera- tion, regeneration, degeneration, or atrophy, including cancer |
| Chemokine MCP-4 GeneSeq Accession W56690 WO9809171 Q99616/CCL13_HUMAN C-C motif chemokine 13 (SEQ ID NO: 347) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune, Inflammatory, and infectious diseases |
| Human stromal cell-derived chemokine, SDF-1 GeneSeq Accession W50766 FR2751658 | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The |

TABLE 2B-continued

Illustrative Proteins, Illustrative Peptides, and Illustrative Indications

| Protein/Peptide Illustrative Identifier Reference | Description/Illustrative Indication(s) |
|---|---|
| P48061/SDF1_HUMAN Stromal cell-derived factor 1 (isoform beta) (SEQ ID NO: 260) | chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. HIV infections |
| Thymus expressed chemokine (TECK) GeneSeq Accession W44397 WO9801557 O15444/CCL25_HUMAN C-C motif chemokine 25 (SEQ ID NO: 348) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and inflammatory disorders |
| Human chemokine MIP-3alpha GeneSeq Accession W44398 WO9801557 P78556/CCL20_HUMAN C-C motif chemokine 20 (isoform 1) (SEQ ID NO: 248) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and inflammatory disorders |
| Human chemokine MIP-3beta GeneSeq Accession W44399 WO9801557 Q99731/CCL19_HUMAN C-C motif chemokine 19 (SEQ ID NO: 249) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and inflammatory disorders |
| Human monocyte chemotactic proprotein (MCPP) sequence GeneSeq Accession W42072 WO9802459 SEQ ID NO: 1 of WO9802459 (SEQ ID NO: 456) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, respiratory disorders, cancer |
| Macrophage- derived chemokine (MDC) GeneSeq Accessions W40811 and Y24414 U.S. Pat. No. 5,688,927/U.S. Pat. No. 5,932,703 O00626/CCL22_HUMAN C-C motif chemokine 22 (SEQ ID NO: 345) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune, and inflammatory disorders, cancer |
| Macrophage derived chemokine analogue MDC-eyfy GeneSeq Accession Y24416 U.S. Pat. No. 5,932,703 ("eyfy" disclosed as SEQ ID NO: 546) Wildtype MDC is SEQ ID NO: 2 of 5,932,703 (SEQ ID NO: 422) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and inflammatory disorders |
| Macrophage derived chemokine analogue MDC (n + 1) GeneSeq Accession Y24413 U.S. Pat. No. 5,932,703 | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which |

TABLE 2B-continued

Illustrative Proteins, Illustrative Peptides, and Illustrative Indications

| Protein/Peptide Illustrative Identifier Reference | Description/Illustrative Indication(s) |
|---|---|
| | bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and inflammatory disorders |
| Macrophage derived chemokine analogue MDC-yl GeneSeq Accession Y24415 U.S. Pat. No. 5,932,703 | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and inflammatory disorders |
| Human type CC chemokine eotaxin 3 protein sequence GeneSeq Accession Y43178 JP11243960 Q9Y258/CCL26_HUMAN C-C motif chemokine 26 (SEQ ID NO: 349) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Allergic diseases and HIV infection |
| Human MCP-3 and human Muc-1 core epitope (VNT) fusion protein GeneSeq Acession Y29893 WO9946392 Wildtype MCP-3 has the sequence: P80098/CCL7_HUMAN C-C motif chemokine 7 (SEQ ID NO: 336) Wildtype Muc-1 has the sequence: P15941|MUC1_HUMAN Mucin-1 (isoform 1) (SEQ ID NO: 461) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer and immune disorders, particularly HIV infection |
| Human IP-10 and human Muc-1 core epitope (VNT) fusion protein GeneSeq Accession Y29894 WO9946392 Wildtype IP10 has the sequence: P02778/CXL10_HUMAN C-X-C motif chemokine 10 (SEQ ID NO: 242) Wildtype Muc-1 has the sequence: P15941|MUC1_HUMAN Mucin-1 (isoform 1) (SEQ ID NO: 461) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer and immune disorders, particularly HIV infection |
| Human IP-10 and HIV-1 gp 120 hyper- variable region fusion protein GeneSeq Accession Y29897 W09946392 Wildtype IP10 has the sequence: P02778/CXL10_HUMAN C-X-C motif chemokine 10 (SEQ ID NO: 242) Wildtype gp120 has the sequence: P03378|32-509 (cleaved product of gp160) (SEQ ID NO: 462) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer and immune disorders, particularly HIV infection |

TABLE 2B-continued

Illustrative Proteins, Illustrative Peptides, and Illustrative Indications

| Protein/Peptide Illustrative Identifier Reference | Description/Illustrative Indication(s) |
| --- | --- |
| Human mammary associated chemokine (MACK) protein Full-Length and Mature GeneSeq Accessions Y29092 and Y29093 WO9936540 Full-length: SEQ ID NO: 1 of WO9936540 (SEQ ID NO: 423) Mature Form: SEQ ID NO: 2 of WO9936540 (SEQ ID NO: 424) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Breast disease, including cancer |
| Tim-1 protein GeneSeq Accession Y28290 WO9933990 SEQ ID NO: 2 of WO9933990 (SEQ ID NO: 350) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammation due to stimuli such as heart attacks and stroke, infection, physical trauma, UV or ionizing radiation, burns, frostbite or corrosive chemicals |
| Human Lkn-1 Full-Length and Mature protein GeneSeq Accessions Y17280, Y17274, Y17281, and Y17275 WO9928473 and WO9928472 Q16663/CCL15_HUMAN C-C motif chemokine 15 (SEQ ID NO: 342) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. HIV infection and cancer, particularly leukemia |
| N-terminal modified chemokine met- hSDF-1 alpha GeneSeq Accession Y05818 WO9920759 SEQ ID NO: 10 of WO9920759 (SEQ ID NO: 425) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inhibit or stimulate angiogenesis, inhibit the binding of HIV |
| N-terminal modified chemokine met- hSDF-1 beta GeneSeq Accession Y05819 WO9920759 SEQ ID NO: 11 of WO9920759 (SEQ ID NO: 426) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inhibit or stimulate angiogenesis, inhibit the binding of HIV, antiinflammatory; immunosuppressant |
| N-terminal modified chemokine GroHEK/hSDF- 1alpha GeneSeq Accession Y05820 WO9920759 SEQ ID NO: 12 of WO9920759 (SEQ ID NO: 427) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inhibit or stimulate angiogenesis, inhibit the binding of HIV, antiinflammatory; immunosuppressant |
| N-terminal modified chemokine GroHEK/hSDF- 1beta. GeneSeq Accession Y05821 WO9920759 SEQ ID NO: 13 of | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which |

TABLE 2B-continued

Illustrative Proteins, Illustrative Peptides, and Illustrative Indications

| Protein/Peptide Illustrative Identifier Reference | Description/Illustrative Indication(s) |
|---|---|
| WO9920759 (SEQ ID NO: 428) | bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inhibit or stimulate angiogenesis, inhibit the binding of HIV, antiinflammatory; immunosuppressant |
| Chemokine Eotaxin GeneSeq Accession Y14230 WO9912968 P51671/CCL11_HUMAN Eotaxin (SEQ ID NO: 245) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Increase or enhance an inflammatory response, an immune response orhaematopoietic cell-associated activity; treat a vascular indication; Cancer; enhance wound healing, to prevent or treat asthma, organ transplant rejction, rheumatoid arthritis or allergy |
| Chemokine hMCP1a GeneSeq Accession Y14225 WO9912968 | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, Vascular disorders, Wound healing, cancer, prevent organ transplant rejection, Increase or enhance an inflammatory response, |
| Chemokine hMCP1b GeneSeq Accession Y14226 WO9912968 | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, Vascular disorders, Wound healing, cancer, prevent organ transplant rejection, Increase or enhance an inflammatory response, |
| Chemokine hSDF1b GeneSeq Accession Y14228 WO9912968 P48061/SDF1_HUMAN Stromal cell-derived factor 1 (isoform beta) (SEQ ID NO: 260) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, Vascular disorders, Wound healing, cancer, prevent organ transplant rejection, Increase or enhance an inflammatory response, |
| Chemokine hIL-8 GeneSeq Accession Y14229 WO9912968 P10145/IL8_HUMAN Interleukin-8 (isoform 1) (SEQ ID NO: 341) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ; and Holmes et al (1991) Science 253, 1278-80. Immune disorders, Vascular disorders, Wound healing, cancer, prevent organ transplant rejection, Increase or enhance an inflammatory response, |
| Chemokine hMCP1 GeneSeq Accession Y14222 WO9912968 | Chemokines are a family of related small, secreted proteins involved in biological processes ranging from hematopoiesis, angiogenesis, and leukocyte trafficking. Members of this family are involved in a similarly diverse range of pathologies |

TABLE 2B-continued

Illustrative Proteins, Illustrative Peptides, and Illustrative Indications

| Protein/Peptide Illustrative Identifier Reference | Description/Illustrative Indication(s) |
|---|---|
| P13500/CCL2_HUMAN C-C motif chemokine 2 (SEQ ID NO: 337) | including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, Vascular disorders, Wound healing, cancer, prevent organ transplant rejection, Increase or enhance an inflammatory response, |
| Chemokine hMCP2 GeneSeq Accession Y14223 WO9912968 P80075/CCL8_HUMAN C-C motif chemokine 8 (SEQ ID NO: 344) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, Vascular disorders, Wound healing, cancer, prevent organ transplant rejection, Increase or enhance an inflammatory response, |
| Chemokine hMCP3 GeneSeq Accession Y14224 WO9912968 P80098/CCL7_HUMAN C-C motif chemokine 7 (SEQ ID NO: 336) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, Vascular disorders, Wound healing, cancer, prevent organ transplant rejection, Increase or enhance an inflammatory response, |
| C-C chemokine, MCP2 GeneSeq Accession Y05300 EP905240 P80075/CCL8_HUMAN C-C motif chemokine 8 (SEQ ID NO: 344) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammatory, Immune and infectious diseases; pulmonary diseases and skin disorders; tumours, and angiogenesis-and haematopoiesis- related diseases |
| Wild type monocyte chemotactic protein 2 GeneSeq Accession Y07233 EP906954 P80075/CCL8_HUMAN C-C motif chemokine 8 (SEQ ID NO: 344) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammatory, Immune and infectious diseases; pulmonary diseases and skin disorders; tumours, and angiogenesis-and haematopoiesis- related diseases |
| Truncated monocyte chemotactic protein 2 (6-76) GeneSeq Accession Y07234 EP906954 FIG. 1 of EP905241 and EP906954 (SEQ ID NO: 429) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power, Humana Press Inc., Totowa, NJ Inflammatory, Immune and infectious diseases; pulmonary diseases and skin disorders; tumours, and angiogenesis-and haematopoiesis- related diseases |
| Truncated RANTES protein (3-68) GeneSeq Accessions Y07236 and | Chemokines are a family of related small, secreted proteins involved in biological processes ranging from hematopoiesis, angiogenesis, and leukocyte trafficking. Members of this family are involved in a similarly diverse range of pathologies |

TABLE 2B-continued

Illustrative Proteins, Illustrative Peptides, and Illustrative Indications

| Protein/Peptide Illustrative Identifier Reference | Description/Illustrative Indication(s) |
|---|---|
| Y07232 EP905241; EP906954 FIG. 1 of EP906954 (SEQ ID NO: 430) | including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power, Humana Press Inc., Totowa, NJ Inflammatory, immune and infectious diseases; pulmonary diseases and skin disorders; tumours, and angiogenesis-and haematopoiesis- related diseases |
| Wild type monocyte chemotactic protein 2 GeneSeq Accession Y07237 EP905241 P80075/CCL8_HUMAN C-C motif chemokine 8 (SEQ ID NO: 344) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power, Humana Press Inc., Totowa, NJ Inflammatory, immune and infectious diseases; pulmonary diseases and skin disorders; tumours, and angiogenesis-and haematopoiesis- related diseases |
| Truncated monocyte chemotactic protein 2 (6-76) GeneSeq Accession Y07238 EP905241 FIG. 1 of EP905241 and EP906954 (SEQ ID NO: 429) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power, Humana Press Inc., Totowa, NJ Inflammatory, immune and infectious diseases; pulmonary diseases and skin disorders; tumours, and angiogenesis-and haematopoiesis- related diseases |
| A partial CXCR4B protein GeneSeq Accession W97363 EP897980 SEQ ID NO: 2 of EP897980 (sEQ ID NO: 431) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power, Humana Press Inc., Totowa, NJ Soluble CXCR4B receptor polypep- tides may be useful for inhibiting chemokine activities and viral infection. |
| Interferon gamma-inducible protein (IP-10) GeneSeq Accession W96709 U.S. Pat. No. 5,871,723 P02778/CXL10_HUMAN C-X-C motif chemokine 10 (SEQ ID NO: 242) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power, Humana Press Inc., Totowa, NJ Angiogenesis, Cancer, Inflammatory and Immune disorders, Cardio- Vascular disorders, Musco-skeletal disorders |
| A monokine induced by gamma-interferon (MIG) GeneSeq Accession W96710 U.S. Pat. No. 5,871,723 Q07325/CXCL9_HUMAN C-X-C motif chemokine 9 (SEQ ID NO: 351) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power, Humana Press Inc., Totowa, NJ Angiogenesis, Cancer, Inflammatory and Immune disorders, Cardio- Vascular disorders, Musco-skeletal disorders |
| Interleukin-8 (IL-8) protein. GeneSeq Accession W96711 U.S. Pat. No. 5,871,723 P10145/IL8_HUMAN | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G- |

TABLE 2B-continued

Illustrative Proteins, Illustrative Peptides, and Illustrative Indications

| Protein/Peptide Illustrative Identifier Reference | Description/Illustrative Indication(s) |
| --- | --- |
| Interleukin-8 (isoform 1) (SEQ ID NO: 341) | protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ; and Holmes et al (1991) Science 253, 1278-80. Angiogenesis, Cancer, Inflammatory and Immune disorders, Cardio- Vascular disorders, Musco-skeletal disorders |
| Epithelial neutrophil activating protein-78 (ENA-78) GeneSeq Accession W96712 U.S. Pat. No. 5,871,723 P42830/CXCL5_HUMAN C-X-C motif chemokine 5 (SEQ ID NO: 352) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power, Humana Press Inc., Totowa, NJ Angiogenesis, Cancer, Inflammatory and Immune disorders, Cardio- Vascular disorders, Musco-skeletal disorders |
| Growth related oncogene-alpha (GRO-alpha). GeneSeq Accession W96713 U.S. Pat. No. 5,871,723 P09341/GROA_HUMAN Growth-regulated alpha protein (SEQ ID NO: 340) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power, Humana Press Inc., Totowa, NJ Angiogenesis, Cancer, Inflammatory and Immune disorders, Cardio- Vascular disorders, Musco-skeletal disorders |
| Growth related oncogene-beta (GRO-beta). GeneSeq Accession W96714 U.S. Pat. No. 5,871,723 P19875/CXCL2_HUMAN C-X-C motif chemokine 2 (SEQ ID NO: 338) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Angiogenesis, Cancer, Inflammatory and Immune disorders, Cardio- Vascular disorders, Musco-skeletal disorders |
| Growth related oncogene-gamma (GRO-gamma) GeneSeq Accession W96715 U.S. Pat. No. 5,871,723 P19876/CXCL3_HUMAN C-X-C motif chemokine 3 (SEQ ID NO: 339) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Angiogenesis, Cancer, Inflammatory and Immune disorders, Cardio- Vascular disorders, Musco-skeletal disorders |
| A platelet basic protein (PBP) GeneSeq Accession W96716 U.S. Pat. No. 5,871,723 P02775/CXCL7_HUMAN Platelet basic protein (SEQ ID NO: 353) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Angiogenesis, Cancer, Inflammatory and Immune disorders, Cardio- Vascular disorders, Musco-skeletal disorders |
| Connective tissue activating protein-III (CTAP-III) GeneSeqAccession S96717 U.S. Pat. No. 5,871,723 SEQ ID NO: 9 of U.S. Pat. No. 5,871,723 (SEQ ID NO: 354) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Angiogenesis, Cancer, Inflammatory and Immune disorders, Cardio- Vascular disorders, Musco-skeletal disorders |

TABLE 2B-continued

Illustrative Proteins, Illustrative Peptides, and Illustrative Indications

| Protein/Peptide Illustrative Identifier Reference | Description/Illustrative Indication(s) |
|---|---|
| Beta-thrombo- globulin protein (beta-TG) GeneSeq Accession W96718 U.S. Pat. No. 5,871,723 SEQ ID NO: 10 of U.S. Pat. No. 5,871,723 (SEQ ID NO: 355) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Angiogenesis, Cancer, Inflammatory and Immune disorders, Cardio- Vascular disorders, Musco-skeletal disorders |
| Neutrophil activating peptide-2 (NAP-2) GeneSeq Accession W96719 U.S. Pat. No. 5,871,723 SEQ ID NO: 11 of U.S. Pat. No. 5,871,723 (SEQ ID NO: 356) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Angiogenesis, Cancer, Inflammatory and Immune disorders, Cardio- Vascular disorders, Musco-skeletal disorders |
| Granulocyte chemotactic protein-2 (GCP-2) GeneSeq Accession W96720 U.S. Pat. No. 5,871,723 P80162/CXCL6_HUMAN C-X-C motif chemokine 6 (SEQ ID NO: 357) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Angiogenesis, Cancer, Inflammatory and Immune disorders, Cardio- Vascular disorders, Musco-skeletal disorders |
| Human chemokine MIG-beta protein GeneSeq Accession W90124 EP887409 (SEQ ID NO: 463) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, viral, parasitic, fungal or bacterial infections, Cancer; autoimmune diseases or transplant rejection |
| Human ZCHEMO-8 GeneSeq Accession W82716 WO9854326 SEQ ID NO: 2 of WO9854326 (SEQ ID NO: 432) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, cancer, myelopoietic disorders, autoimmune disorders and immunodeficiencies, Inflammatory and infectious diseases, Vascular disorders, wound healing |
| Human Act-2 protein GeneSeq Accession W82717 WO9854326 P13236/CCL4_HUMAN C-C motif chemokine 4 (SEQ ID NO: 358) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, cancer, myelopoietic disorders, autoimmune disorders and immunodeficiencies, Inflammatory and infectious diseases, Vascular disorders, wound healing |
| Human SISD protein GeneSeq Acession W82720 WO9854326 | Chemokines are a family of related small, secreted proteins involved in biological processes ranging from hematopoiesis, angiogenesis, and leukocyte trafficking. Members of this family are involved in a similarly diverse range of pathologies |

TABLE 2B-continued

Illustrative Proteins, Illustrative Peptides, and Illustrative Indications

| Protein/Peptide Illustrative Identifier Reference | Description/Illustrative Indication(s) |
| --- | --- |
| P13501/CCL5_HUMAN C-C motif chemokine 5 (SEQ ID NO: 241) | including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, cancer, myelopoietic disorders, autoimmune disorders and immunodeficiencies, Inflammatory and infectious diseases, Vascular disorders, wound healing |
| Human MI10 protein GeneSeq Accession W82721 WO9854326 SEQ ID NO: 37 of WO9854326 (SEQ ID NO: 433) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, cancer, myelopoietic disorders, autoimmune disorders and immunodeficiencies, Inflammatory and infectious diseases, Vascular disorders, wound healing |
| Human MI1A protein GeneSeq Accession W82722 W09854326 SEQ ID NO: 38 of WO9854326 (SEQ ID NO: 434) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, cancer, myelopoietic disorders, autoimmune disorders and immunodeficiencies, Inflammatory and infectious diseases, Vascular disorders, wound healing |
| Human CCC3 protein GeneSeq Accession W82723 WO9854326 SEQ ID NO: 39 of WO9854326 (SEQ ID NO: 435) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune disorders, cancer, myelopoietic disorders, autoimmune disorders and immunodeficiencies, Inflammatory and infectious diseases, Vascular disorders, wound healing |
| A human L105 chemokine designated huL105_3. GeneSeq Accession W87588 WO9856818 SEQ ID NO: 2 of WO9856818 (SEQ ID NO: 436) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer, wound healing |
| A human L105 chemokine designated huL105_7. GeneSeq Accession W87589 WO9856818 SEQ ID NO: 4 of WO9856818 (SEQ ID NO: 437) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer, wound healing |
| Human mature gro-alpha polypeptide used to treat sepsis GeneSeq Accession W81498 WO9848828 P09341/GROA_HUMAN Growth-regulated alpha | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined |

TABLE 2B-continued

Illustrative Proteins, Illustrative Peptides, and Illustrative Indications

| Protein/Peptide Illustrative Identifier Reference | Description/Illustrative Indication(s) |
|---|---|
| protein (SEQ ID NO: 340) | using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Infectious diseases, sepsis |
| Human mature gro-gamma polypeptide used to treat sepsis GeneSeq Accession W81500 WO9848828 P19876/CXCL3_HUMAN C-X-C motif chemokine 3 (SEQ ID NO: 339) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Infectious diseases, sepsis |
| Human thymus expressed chemokine TECK and TECK variant GeneSeq Accessions B19607 and B19608 WO0053635 Wildtype TECK provided as: O15444/CCL25_HUMAN C-C motif chemokine 25 (SEQ ID NO: 348) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Inflammatory disorders, cancer, Immune and vascular disorders |
| Human chemokine SDF1alpha GeneSeq Accession B15791 WO0042071 P48061-2/SDF1_HUMAN Isoform Alpha of Stromal cell-derived factor 1 (isoform alpha) (SEQ ID NO: 259) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine GRO-alpha GeneSeq Accession B15793 WO0042071 P09341/GROA_HUMAN Growth-regulated alpha protein (SEQ ID NO: 340) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine eotaxin GeneSeq Accession B15794 WO0042071 P51671/CCL11_HUMAN Eotaxin (SEQ ID NO: 245) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine MIG GeneSeq Accession B15803 WO0042071 Q07325/CXCL9_HUMAN C-X-C motif chemokine 9 (SEQ ID NO: 351) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |

TABLE 2B-continued

Illustrative Proteins, Illustrative Peptides, and Illustrative Indications

| Protein/Peptide Illustrative Identifier Reference | Description/Illustrative Indication(s) |
|---|---|
| Human chemokine PF4 GeneSeq Accession B15804 WO0042071 P02776/PLF4_HUMAN Platelet factor 4 (SEQ ID NO: 359) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine I-309 GeneSeq Accession B15805 WO0042071 P22362/CCL1_HUMAN C-C motif chemokine 1 (SEQ ID NO: 360) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine HCC-1 GeneSeq Accession B15806 WO0042071 Q16627/CCL14_HUMAN C-C motif chemokine 14 (SEQ ID NO: 361) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine C10 GeneSeq Accession B15807 WO0042071 SEQ ID NO: 49 of WO0042071 (SEQ ID NO: 438) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine CCR-2 GeneSeq Accession B15808 WO0042071 P41597/CCR2_HUMAN C-C chemokine receptor type 2 (isoform A) (SEQ ID NO: 362) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine ENA-78 GeneSeq Accession B15809 WO0042071 P42830/CXCL5_HUMAN C-X-C motif chemokine 5 (SEQ ID NO: 352) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine GRObeta GeneSeq Accession B15810 WO0042071 P19875/CXCL2_HUMAN C-X-C motif chemokine 2 (SEQ ID NO: 338) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: |

TABLE 2B-continued

Illustrative Proteins, Illustrative Peptides, and Illustrative Indications

| Protein/Peptide Illustrative Identifier Reference | Description/Illustrative Indication(s) |
|---|---|
| | Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine IP-10 GeneSeq Accession B15811 WO0042071 P02778/CXL10_HUMAN C-X-C motif chemokine 10 (SEQ ID NO: 242) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine SDF1beta GeneSeq Accession B15812 WO0042071 P48061/SDF1_HUMAN Stromal cell-derived factor 1 (isoform beta) (SEQ ID NO: 260) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine GRO alpha GeneSeq Accession B15813 WO0042071 P09341/GROA_HUMAN Growth-regulated alpha protein (SEQ ID NO: 340) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| Human chemokine MIP1beta GeneSeq Accession B15831 WO0042071 P13236/CCL4_HUMAN C-C motif chemokine 4 (SEQ ID NO: 358) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Autoimmune disorders, Immune, Vascular and Inflammatory disorders |
| A human C-C chemokine designated exodus GeneSeq Accession B07939 U.S. Pat. No. 6,096,300 P78556/CCL20_HUMAN C-C motif chemokine 20 (isoform 1) (SEQ ID NO: 248) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer |
| Human chemokine L105_7 GeneSeq Accession Y96922 U.S. Pat. No. 6,084,071 SEQ ID NO: 4 of WO9856818 (SEQ ID NO: 437) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Chemotaxis, Gene Therapy, Wound healing |
| Human chemokine L105_3 GeneSeq Accession Y96923 U.S. Pat. No. 6,084,071 SEQ ID NO: 2 of WO9856818 (SEQ ID NO: 436) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined |

TABLE 2B-continued

Illustrative Proteins, Illustrative Peptides, and Illustrative Indications

| Protein/Peptide Illustrative Identifier Reference | Description/Illustrative Indication(s) |
|---|---|
| | using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Chemotaxis, Gene Therapy, Wound healing |
| Human secondary lymphoid chemokine (SLC) GeneSeq Accession B01434 WO0038706 O00585/CCL21_HUMAN C-C motif chemokine 21 (SEQ ID NO: 346) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer, Vascular and Immune disorders |
| Human non- ELR CXC chemokine H174 GeneSeq Accession Y96310 WO0029439 O14625/CXL11_HUMAN C-X-C motif chemokine 11 (SEQ ID NO: 363) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and Inflammatory disorders, Cancer, Haemostatic and thrombolytic activity |
| Human non-ELR CXC chemokine IP10 GeneSeq Accession Y96311 WO0029439 P02778/CXL10_HUMAN C-X-C motif chemokine 10 (SEQ ID NO: 242) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and Inflammatory disorders, Cancer, haemostatic and thrombolytic activity |
| Human non-ELR CXC chemokine Mig GeneSeq Accession Y96313 WO0029439 Q07325/CXCL9_HUMAN C-X-C motif chemokine 9 (SEQ ID NO: 351) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Immune and Inflammatory disorders, Cancer, haemostatic and thrombolytic activity |
| Human chemokine Ckbeta-7 GeneSeq Accession Y96280 WO0028035 FIG. 1 of WO0028035 (SEQ ID NO: 439) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer, wound healing, inflammatory and immunoregulatory disorders |
| Human chemokine MIP-1alpha GeneSeq Accession Y96281 WO0028035 P10147/CCL3_HUMAN C-C motif chemokine 3 (SEQ ID NO: 364) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer, wound healing, inflammatory and immunoregulatory disorders |
| Human mature chemokine Ckbeta-7 (optionally truncated) GenSeq Accession Y96282 | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The |

TABLE 2B-continued

Illustrative Proteins, Illustrative Peptides, and Illustrative Indications

Figure 1:
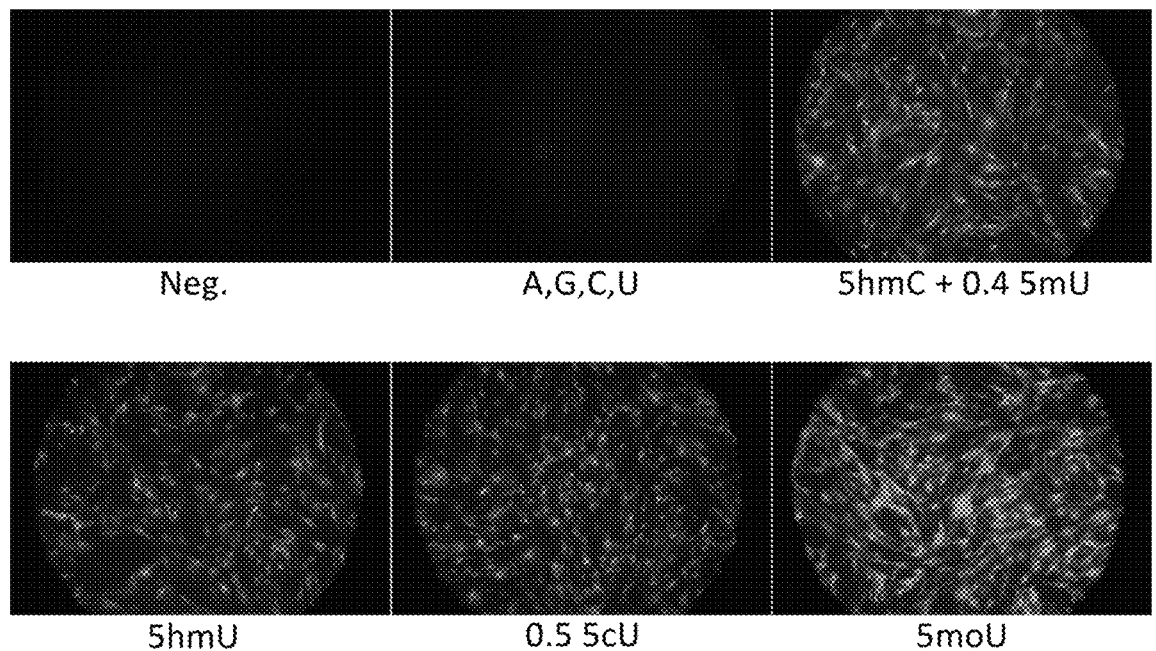
Figure 2:
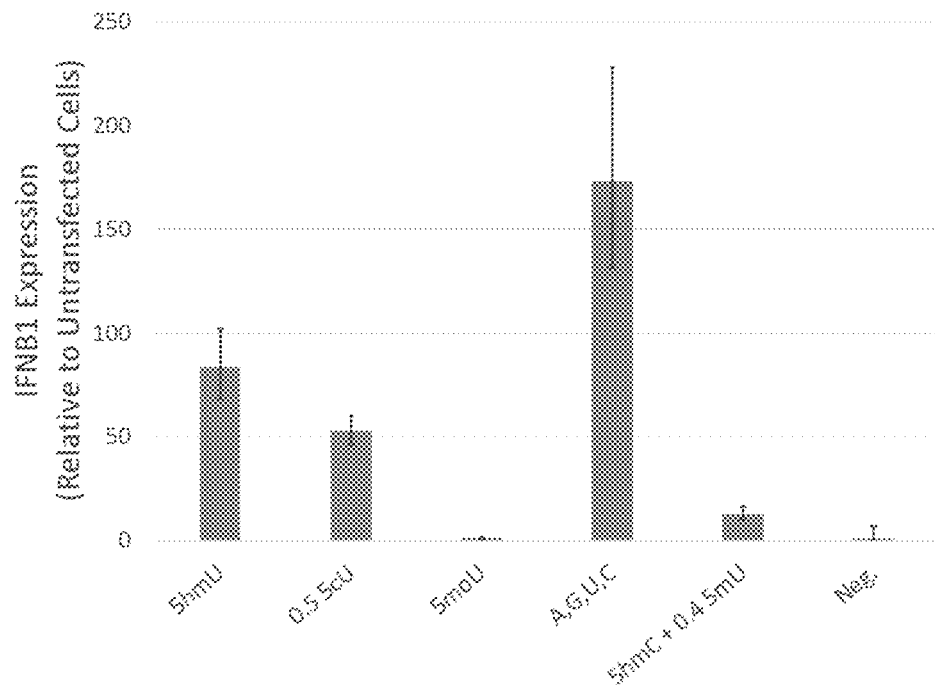

| Protein/Peptide Illustrative Identifier Reference | Description/Illustrative Indication(s) |
|---|---|
| WO0028035 FIG. 1 of WO0028035 (SEQ ID NO: 440) | chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer, wound healing, inflammatory and immunoregulatory disorders |
| Human chemokine receptor CXCR3 GeneSeq Accession Y79372 WO0018431 P49682\|CXCR3_HUMAN C-X-C chemokine receptor type 3 (isoform 1) (SEQ ID NO: 240) | Chemokines are a family of related small, secreted proteins involved in biological processes ranging from Chemokine activities can be determined using assays known in the art: Methods in Molecular Biology, 2000, vol. 138: Soluble CXCR3 polypeptides may be useful for inhibiting |
| Human neurotactin chemokine like domain GeneSeq Accession Y53259 U.S. Pat. No. 6,043,086 P78423/X3CL1_HUMAN Fractalkine (SEQ ID NO: 244) | hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine Protocols. Edited by: A. E. I. Proudfoot, T. N. C. Wells, and C. A. Power. Humana Press Inc., Totowa, NJ. chemokine activities and viral infection. |
| Human CC type chemokine interleukin C GeneSeq Accession Y57771 JP11302298 | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer and infectious diseases |
| Human CKbeta-9 GeneSeq Accession B50860 U.S. Pat. No. 6,153,441 O00585/CCL21_HUMAN C-C motif chemokine 21 (SEQ ID NO: 346) | Chemokines are a family of related small, secreted proteins involved in biological processes ranging from hematopoiesis, angiogenesis, and leukocyte trafficking. Members of this family are involved in a similarly diverse range of pathologies including inflammation, allergy, tissue rejection, viral infection, and tumor biology. The chemokines exert their effects by acting on a family of seven transmembrane G-protein coupled receptors. Over 40 human chemokines have been described, which bind to ~17 receptors thus far identified. Chemokine activities can be determined using assays known in the art: Methods in Molecular Biology, 2000, vol. 138: Chemokine Protocols. Edited by: A. E. I. Proudfoot, T. N. C. Wells, and C. A. Power. Humana Press Inc., Totowa, NJ. Cancer, Auto- immune and inflammatory disorders, Cardiovascular disorders |
| Preproapolipo- protein "paris" variant GeneSeq Accession W08602 WO9637608 (SEQ ID NO: 466) | Apoa-1 participates in the reverse transport of cholesterol from tissues to the liver for excretion by promoting cholesterol efflux from tissues and by acting as a cofactor for the lecithin cholesterol acyltransferase (Icat). Lipid binding activity can be determined using assays known in the art, such as, for example, the Cholesterol Efflux Assays of Takahaski et al., P. N. A. S., Vol. 96, Issue 20, 11358-11363, Sep. 28, 1999. Useful for cardio- vascular disorders, cholesterol disorders, and Hyperlipidaemia |
| Preproapolipo- protein "milano" variant 5,721,114 SEQ ID NO: 6 of U.S. Pat. No. 5,721,114 (SEQ ID NO: 441) | Apoa-1 participates in the reverse transport of cholesterol from tissues to the liver for excretion by promoting cholesterol efflux from tissues and by acting as a cofactor for the lecithin cholesterol acyltransferase (Icat). Lipid binding activity can be determined using assays known in the art, such as, for example, the Cholesterol Efflux Assays of Takahaski et al., P. N. A. S., Vol. 96, Issue 20, 11358-11363, Sep. 28, 1999. Useful for cardio- vascular disorders, cholesterol disorders, and Hyperlipidaemia |
| Glycodelin-A; Progesterone- associated endometrial protein GeneSeq Accession W00289 WO9628169 P09466/PAEP_HUMAN Glycodelin (SEQ ID NO: 365) | Naturally produced female contraceptive that is removed rapidly from the body following 2-3 days production. Uses include contraception Glycodelin-A activity can be determined using the hemizona assay as described in Oehninger, S., Coddington, C. C., Hodgen, G. D., and Seppala, M (1995) Fertil. Steril. 63, 377-383. Naturally derived contraceptive useful for the prevention of pregnancy. |
| NOGO-A Genbank Accession CAB99248 (SEQ ID NO: 366) | NOGO polypeptides are potent inhibitors of neurite growth. Inhibition of Neurite outgrowth. Antagonists to NOGO polypeptides may promote the outgrowth of neurites, thus inducing regeneration of neurons. NOGO-A polypep- tide antagonists are useful for the pro- motion of neural growth, which could be useful in the treatment of neural disorders and dys- function due to de- generative diseases or trauma; useful in the treatment of neo- plastic diseases of the CNS; induce regeneration of neurons or to promote the structural plasticity of the CNS. |

TABLE 2B-continued

Illustrative Proteins, Illustrative Peptides, and Illustrative Indications

| Protein/Peptide Illustrative Identifier Reference | Description/Illustrative Indication(s) |
|---|---|
| NOGO-B Genbank Accession CAB99249 (SEQ ID NO: 367) | NOGO polypeptides are potent inhibitors of neurite growth. Inhibition of Neurite outgrowth. Antagonists to NOGO polypeptides may promote the outgrowth of neurites, thus inducing regeneration of neurons. NOGO-B polypep- tide antagonists are useful for the pro- motion of neural growth, which could be useful in the treatment of neural disorders and dys- function due to de- generative diseases or trauma; useful in the treatment of neo- plastic diseases of the CNS; induce regeneration of neurons or to promote the structural plasticity of the CNS. |
| NOGO-C Genbank Accession CAB99250 (SEQ ID NO: 368) | NOGO polypeptides are potent inhibitors of neurite growth. Inhibition of Neurite outgrowth. Antagonists to NOGO polypeptides may promote the outgrowth of neurites, thus inducing regeneration of neurons. NOGO-C polypep- tide antagonists are useful for the pro- motion of neural growth, which could be useful in the treatment of neural disorders and dys- function due to de- generative diseases or trauma; useful in the treatment of neo- plastic diseases of the CNS; induce regeneration of neurons or to promote the structural plasticity of the CNS. |
| NOGO-66 Receptor Genbank Accession AAG53612 (SEQ ID NO: 369) | NOGO polypeptides are potent inhibitors of neurite growth, and are thought to mediate their effects through the NOGO-66 Receptor. Inhibition of Neurite outgrowth by mediating the biological effects of NOGO polypeptides. Soluble NOGO- 66 receptor polypeptides may promote the outgrowth of neurites, thus inducing regeneration of neurons. NOGO-66 receptor polypeptides are useful for the promotion of neural growth, which could be useful in the treatment of neural disorders and dys- function due to de- generative diseases or trauma; useful in the treatment of neo- plastic diseases of the CNS; induce regeneration of neurons or to promote the structural plasticity of the CNS. |
| Antibodies specific for collapsin U.S. Pat. No. 5,416,197 Wildtype collapsin has the sequence: SEQ ID NO: 2 of 5,416,197 (SEQ ID NO: 464) | These antibodies are useful for the promotion of neurite outgrowth Collapsin activity, which is thought to inhibit the outgrowth of neurites, can be assayed in the presence of antibodies specific for collapsing using assays known in the art, such as, for example, the collapse assay disclosed by Luo et al., Cell 1993 Oct. 22; 75(2): 217-27 Useful for the pro- motion of neural growth, which could be useful in the treatment of neural disorders and dys- function due to de- generative diseases or trauma. |
| Humanized Anti-VEGF Antibodies, and fragments thereof WO9845331 | These agents have anti-inflammatory and anti-cancer applications VEGF activity can be determined using assays known in the art, such as those disclosed in International Publication No. WO0045835, for example. Promotion of growth and proliferation of cells, such as vascular endothelial cells. Antagonists may be useful as anti-angiogenic agents, and may be applicable for cancer |
| Humanized Anti-VEGF Antibodies, and fragments thereof WO0029584 | These agents have anti-inflammatory and anti-cancer applications VEGF activity can be determined using assays known in the art, such as those disclosed in International Publication No. WO0045835, for example. Promotion of growth and proliferation of cells, such as vascular endothelial cells. Hematopoietic and immune dis- orders. Antagonists may be useful as antiangiogenic agents, and may be applicable for cancer |
| Membrane bound proteins GeneSeq. Accession Y66631-Y66765 WO9963088 | Cancer, Immune Disorders These proteins can be used for linking bioactive molecules to cells and for modulating biological activities of cells, using the polypeptides for specific targeting. The polypeptide targeting can be used to kill the target cells, e.g. for the treatment of cancers. These proteins are useful for the treatment of immune system disorders. Activities can be determined using assay known in the art, such as, for example, the assays disclosed in International Publication No. WO0121658. |
| Secreted and Transmembrane polypeptides GeneSeq Accession B44241-B44334 WO0053756 | Cancer, Immune Disorders These proteins can be used for linking bioactive molecules to cells and for modulating biological activities of cells, using the polypeptides for specific targeting. The polypeptide targeting can be used to kill the target cells, e.g. for the treatment of cancers. These proteins are useful for the treatment of immune system disorders. Activities can be determined using assay known in the art, such as, for example, the assays disclosed in International Publication No. WO0121658. |
| Secreted and Transmembrane polypeptides GeneSeq Accession Y41685-Y41774 WO9946281 | Cancer, Immune Disorders These proteins can be used for linking bioactive molecules to cells and for modulating biological activities of cells, using the polypeptides for specific targeting. The polypeptide targeting can be used to kill the target cells, e.g. for the treatment of cancers. These proteins are useful for the treatment of immune system disorders. Activities can be determined using assay known in the art, such as, for example, the assays disclosed in International Publication No. WO0121658. |
| Interleukin 2 (IL-2) SEQ ID NO: 548 | Metabolic Disease, Type 1 diabetes, Graft-versus-host disease. |
| Interleukin 15_vA (IL-15_vA) SEQ ID NO: 549 | Obesity, Metabolic Disease, Diabetes. |
| Interleukin 15_vB (IL-15_vB) SEQ ID NO: 550 | Obesity, Metabolic Disease, Diabetes. |
| Interleukin 15_vC (IL-15_vC) SEQ ID NO: 551 | Obesity, Metabolic Disease, Diabetes. |

TABLE 2B-continued

Illustrative Proteins, Illustrative Peptides, and Illustrative Indications

| Protein/Peptide Illustrative Identifier Reference | Description/Illustrative Indication(s) |
|---|---|
| Interleukin 15_vD (IL15_vD) SEQ ID NO: 552 | Obesity, Metabolic Disease, Diabetes. |
| Interleukin 15_vE (IL15_vE) SEQ ID NO: 553 | Obesity, Metabolic Disease, Diabetes. |
| Interleukin 15_vF (IL15_vF) SEQ ID NO: 565 | Obesity, Metabolic Disease, Diabetes. |
| Interleukin 22 (IL22) SEQ ID NO: 554 | Metabolic Disease, Diabetic Ulcers, Inflamatory Bowel Diseases. |
| Fibroblast Growth Factor 1 (FGF1) SEQ ID NO: 555 | Diabetes, Metabolic Disease, Obesity. |
| Fibroblast Growth Factor 1_vA (FGF1_vA) SEQ ID NO: 556 | Diabetes, Metabolic Disease, Obesity. See Nature 513, 436-439 (18 Sep. 2014) doi: 10.1038/nature13540. |
| Fibroblast Growth Factor 1_vB (FGF1_vB) SEQ ID NO: 557 | Diabetes, Metabolic Disease, Obesity. See Proc Natl Acad Sci USA. 1991 Apr. 1; 88(7): 2893-2897. |
| Fibroblast Growth Factor 1_vC (FGF1_vC) SEQ ID NO: 566 | Diabetes, Metabolic Disease, Obesity. |
| Fibroblast Growth Factor 19_vA (FGF19_vA) SEQ ID NO: 558 | Chronic liver disease, primary biliary cirrhosis, bile acid-induced liver damage. See Cancer Res. 2014 Jun. 15; 74(12): 3306-16. doi: 10.1158/0008-5472.CAN-14-0208. Epub 2014 Apr. 11. Regulates bile acid metabolism without tumorigenicity. |
| Fibroblast Growth Factor 21 (FGF21) SEQ ID NO: 559 | Metabolic Disease, Fibrotic Diseases. |
| Fibroblast Growth Factor 23 (FGF23) SEQ ID NO: 560 | Hyperphosphatemic familial tumoral calcinosis. |
| Brain-Derived Neurotrophic Factor (BDNF) SEQ ID NO: 561 | Neurological diseases (including Alzheimer's Disease, Autism, Huntington's Disease, Parkinson's Disease, and Depression), obesity, metabolic disease. |
| Serpin Peptidase Inhibitor, Clade B (Ovalbumin), Member 1 (SERPINB1) SEQ ID NO: 562 | Diabetes. |
| CASPASE1 SEQ ID NO: 563 | Diabetes. |
| Leukemia Inhibitory Factor (LIF) SEQ ID NO: 564 | Muscular dystrophy, atherosclerosis, kidney disease |
| Proprotein Convertase Subtilisin/Kexin Type 1 (PCSK1) SEQ ID NO: 567 | Cardiovascular disease, hypercholesterolemia, heterozygous familial hypercholesterolemia (HeFH), atherosclerotic cardiovascular disease such as heart attacks or strokes, increasing the amount of a functional protein, polypeptide or peptide |
| Proprotein Convertase Subtilisin/Kexin Type 2 (PCSK2) SEQ ID NO: 568 | Cardiovascular disease, hypercholesterolemia, heterozygous familial hypercholesterolemia (HeFH), atherosclerotic cardiovascular disease such as heart attacks or strokes, increasing the amount of a functional protein, polypeptide or peptide |
| Proprotein Convertase Subtilisin/Kexin Type 3 (PCSK3) SEQ ID NO: 569 | Cardiovascular disease, hypercholesterolemia, heterozygous familial hypercholesterolemia (HeFH), atherosclerotic cardiovascular disease such as heart attacks or strokes, increasing the amount of a functional protein, polypeptide or peptide |
| Proprotein Convertase Subtilisin/Kexin Type 3 Sol (PCSK3_SOL) SEQ ID NO: 570 | Cardiovascular disease, hypercholesterolemia, heterozygous familial hypercholesterolemia (HeFH), atherosclerotic cardiovascular disease such as heart attacks or strokes, increasing the amount of a functional protein, polypeptide or peptide |
| Proprotein Convertase Subtilisin/Kexin Type 4 (PCSK4) SEQ ID NO: 571 | Cardiovascular disease, hypercholesterolemia, heterozygous familial hypercholesterolemia (HeFH), atherosclerotic cardiovascular disease such as heart attacks or strokes, increasing the amount of a functional protein, polypeptide or peptide |

TABLE 2B-continued

Illustrative Proteins, Illustrative Peptides, and Illustrative Indications

| Protein/Peptide Illustrative Identifier Reference | Description/Illustrative Indication(s) |
|---|---|
| Proprotein Convertase Subtilisin/Kexin Type 5 (PCSK5) SEQ ID NO: 572 | Cardiovascular disease, hypercholesterolemia, heterozygous familial hypercholesterolemia (HeFH), atherosclerotic cardiovascular disease such as heart attacks or strokes, increasing the amount of a functional protein, polypeptide or peptide |
| Proprotein Convertase Subtilisin/Kexin Type 6 (PCSK6) SEQ ID NO: 573 | Cardiovascular disease, hypercholesterolemia, heterozygous familial hypercholesterolemia (HeFH), atherosclerotic cardiovascular disease such as heart attacks or strokes, increasing the amount of a functional protein, polypeptide or peptide |
| Proprotein Convertase Subtilisin/Kexin Type (PCSK7) SEQ ID NO: 574 | Cardiovascular disease, hypercholesterolemia, heterozygous familial hypercholesterolemia (HeFH), atherosclerotic cardiovascular disease such as heart attacks or strokes, increasing the amount of a functional protein, polypeptide or peptide |
| Proprotein Convertase Subtilisin/Kexin Type 8 (PCSK8) SEQ ID NO: 575 | Cardiovascular disease, hypercholesterolemia, heterozygous familial hypercholesterolemia (HeFH), atherosclerotic cardiovascular disease such as heart attacks or strokes, increasing the amount of a functional protein, polypeptide or peptide |
| Proprotein Convertase Subtilisin/Kexin Type 9 (PCSK9) SEQ ID NO: 576 | Cardiovascular disease, hypercholesterolemia, heterozygous familial hypercholesterolemia (HeFH), atherosclerotic cardiovascular disease such as heart attacks or strokes, increasing the amount of a functional protein, polypeptide or peptide |
| Membrane-Bound Transcription Factor Peptidase, Site 2 (MBTPS2) SEQ ID NO: 577 | IFAP syndrome, increasing the amount of a functional protein, polypeptide or peptide |
| Carboxypeptidase E (CPE) SEQ ID NO: 578 | Endocrine disorders, such as, for example, obesity and infertility; hyperproinsulinemia; metabolic syndrome, increasing the amount of a functional protein, polypeptide or peptide |

In various embodiments, the nucleic acid drug, including synthetic RNA, is administered is a manner that it effects one or more of keratinocytes and fibroblasts (e.g. causes these cells to express one or more therapeutic proteins). For example, present methods allow for methods in which a patient's cells are used to generate a therapeutic protein and the levels of such protein are tailored by synthetic RNA dosing.

In a specific embodiment, the synthetic RNA targets a soluble protein. In some embodiments, the synthetic RNA targets a protein of one or more of the following families of proteins: transforming growth factor (TGF) beta, bone morphogenetic proteins (BMPs), Fibroblast growth factors (FGFs), vascular endothelial growth factors (VEGFs), and interleukins. The terms "family", "superfamily", and "subfamily" can be used interchangeably In a specific embodiment, the synthetic RNA targets a member of the TGF beta family. TGF-β superfamily proteins comprise cytokines characterized by six-conserved cysteine residues (Lander et al., (2001) Nature, 409:860-921). The human genome contains at least about 42 open reading frames encoding TGF-β superfamily proteins. TGF-β superfamily proteins can at least be divided into the BMP subfamily and the TGF-β subfamily based on sequence similarity and the specific signaling pathways that they activate. In various embodiments, the synthetic RNA targets one or more of TGFs (e.g., TGF-β1, TGF-β2, and TGF-β3), activins (e.g., activin A) and inhibins, macrophage inhibitory cytokine-1 (MIC-1), Mullerian inhibiting substance, anti-Mullerian hormone, and glial cell line derived neurotrophic factor (GDNF).

The TGF-β superfamily comprises a subset of the cysteine knot cytokine superfamily. Additional members of the cysteine knot cytokine superfamily include, but are not limited to, platelet derived growth factor (PDGF), vascular endothelial growth factor (VEGF), placenta growth factor (PlGF), Noggin, neurotrophins (BDNF, NT3, NT4, and βNGF), gonadotropin, follitropin, lutropin, interleukin-17, and coagulogen. This family of proteins is also among the targets encompassed by the present invention.

In various embodiments, the present invention relates to targeting a TGF beta family member for treatment or prevention of various immunological disorders, cancer, bronchial asthma, lung fibrosis, heart disease, diabetes, hereditary hemorrhagic telangiectasia, Marfan syndrome, Vascular Ehlers-Danlos syndrome, Loeys-Dietz syndrome, Parkinson's disease, chronic kidney disease, multiple sclerosis and AIDS.

In a specific embodiment, the synthetic RNA targets a member of the BMP family. The BMP subfamily includes, but is not limited to, BMP-2, BMP-3 (osteogenin), BMP-3b (GDF-10), BMP-4 (BMP-2b), BMP-5, BMP-6, BMP-7 (osteogenic protein-1 or OP-1), BMP-8 (OP-2), BMP-8B (OP-3), BMP-9 (GDF-2), BMP-10, BMP-11 (GDF-11), BMP-12 (GDF-7), BMP-13 (GDF-6, CDMP-2), BMP-15 (GDF-9), BMP-16, GDF-1, GDF-3, GDF-5 (CDMP-1), and GDF-8 (myostatin). In various embodiments, the synthetic RNA targets one or more of BMP-2, BMP-3 (osteogenin), BMP-3b (GDF-10), BMP-4 (BMP-2b), BMP-5, BMP-6, BMP-7 (osteogenic protein-1 or OP-1), BMP-8 (OP-2), BMP-8B (OP-3), BMP-9 (GDF-2), BMP-10, BMP-11 (GDF-11), BMP-12 (GDF-7), BMP-13 (GDF-6, CDMP-2), BMP-15 (GDF-9), BMP-16, GDF-1, GDF-3, GDF-5 (CDMP-1), and GDF-8 (myostatin). BMPs are sometimes referred to as Osteogenic Protein (OPs), Growth Differentiation Factors (GDFs), or Cartilage-Derived Morphogenetic Proteins (CDMPs). In a specific embodiment, the synthetic RNA targets one or more BMP fusions (e.g. as described in US Patent Publication No. 2009/0202638, the entire contents of which are hereby incorporated by reference) and/or one or more BMP mutants (e.g. as described in US Patent Publication No. 2011/0039773, the entire contents of which are hereby incorporated by reference).

In various embodiments, the present invention relates to targeting a BMP family member for regenerative medicine or metabolic applications, including without limitation orthopedic applications such as spinal fusions, nonunions and oral surgery, metabolic disease, prediabetes, diabetes, thermogenesis, insulin sensitivity, insulin resistance, and adipogenesis, including brown-fat adipogenesis. Various other metabolic applications are described elsewhere herein. In various embodiments, the present invention relates to targeting a BMP family member, including BMP-7, for treatment of chronic kidney disease (CKD) and/or to reverse the loss of glomeruli due to sclerosis.

In various embodiments, the present invention relates to targeting a BMP family member to induce proliferation of bone and cartilage in a variety of locations in the body. For example, repair of joints such as knee, elbow, ankle, and finger joints are contemplated by the invention. For example, targeting a BMP family member may result in regenerating cartilage in patients suffering from arthritis or other cartilage degenerating diseases. Further, the invention pertains to treating tears in cartilage due to injury. In addition, the invention is useful for inducing bone growth in patients, for instance, by way of non-limitation, for use in treating patients suffering from bone fractures or breaks, osteoporosis, or patients in need of spinal fusion or for repair of the spine, vertebrae or the like.

In various embodiments, the present invention relates to targeting a BMP family member to induce a developmental cascade of bone morphogenesis and tissue morphogenesis for a variety of tissues in mammals different from bone or bone cartilage. This morphogenic activity includes the ability to induce proliferation and differentiation of progenitor cells, and the ability to support and maintain the differentiated phenotype through the progression of events that results in the formation of bone, cartilage, non-mineralized skeletal or connective tissues, and other adult tissues.

For example, the present invention may be used for treatment to prevent loss of and/or increase bone mass in metabolic bone diseases. General methods for treatment to prevent loss of and/or increase bone mass in metabolic bone diseases using osteogenic proteins are disclosed in U.S. Pat. No. 5,674,844, the entire contents of which are hereby incorporated by reference. Further the present compositions and methods find use in replacing or repairing bone or cartilage at injury sites such as bone breaks, bone fractures, and cartilage tears, periodontal tissue regeneration (e.g. general methods for periodontal tissue regeneration using osteogenic proteins are disclosed in U.S. Pat. No. 5,733,878, the entire contents of which are hereby incorporated by reference), liver regeneration, including following a partial hepatectomy (see, e.g., U.S. Pat. No. 5,849,686, the entire contents of which are hereby incorporated by reference), treatment of chronic renal failure (see, e.g., U.S. Pat. No. 6,861,404, the entire contents of which are hereby incorporated by reference), enhancing functional recovery following central nervous system ischemia or trauma (see, e.g. U.S. Pat. No. 6,407,060, the entire contents of which are hereby incorporated by reference), inducing dendritic growth (see, e.g., U.S. Pat. No. 6,949,505, the entire contents of which are hereby incorporated by reference), inducing neural cell adhesion (see, e.g., U.S. Pat. No. 6,800,603, the entire contents of which are hereby incorporated by reference), and treatment and prevention of Parkinson's disease (see, e.g., U.S. Pat. No. 6,506,729, the entire contents of which are hereby incorporated by reference). As another example, the present compositions and methods, including when targeting one or more BMPs, can be used to induce dentinogenesis. To date, the unpredictable response of dental pulp tissue to injury is a basic clinical problem in dentistry. Using standard dental surgical procedures, small areas (e.g., 2 mm) of dental pulps can be surgically exposed by removing the enamel and dentin immediately above the pulp (by drilling) of sample teeth, performing a partial amputation of the coronal pulp tissue, inducing hemostasis, application of the pulp treatment, and sealing and filling the cavity by standard procedures.

In various embodiments, the present invention relates to targeting a BMP family member for the treatment of one or more metabolic-related disorders as described herein.

In a specific embodiment, the synthetic RNA targets a member of the FGF family. FGFs are a family of growth factors, with members involved in angiogenesis, wound healing, embryonic development and various endocrine signaling pathways. In various embodiments, any one of the following FGFs are targets of the invention: FGF1, FGF2, FGF3, FGF4, FGF5, FGF6, FGF7, FGF8, FGF9, FGF10, FGF11, FGF12, FGF13, FGF14 (FGF11, FGF12, FGF13, and FGF14 being FGF homologous factors 1-4 (FHF1-FHF4)), FGF16, FGF17, FGF18, FGF19 (aka FHF15/19), FGF20, FGF21, FGF22 and FGF22. In some embodiments, the synthetic RNA targets a cognate receptor of any of the above FGFs. In various embodiments, the present invention relates to targeting a FGF family member to a treat or prevent disease or disorder associated with abnormal function and/or expression of an FGF, a metabolic disease or disorder (e.g., diabetes, obesity, dyslipidemia, hyperglycemia, hyperinsulinemia, hypertension, hepatosteaotosis such as non-alcoholic steatohepatitis (NASH) etc.), cancer, a disease or disorder associated with impaired lipid metabolism a disease or disorder associated with impaired renal function, a disease or disorder associated with impaired hepatic function, abnormal cell proliferation, a vascular disease or disorder (e.g., coronary artery disease, peripheral artery disease, atherosclerosis, abdominal aortic aneurysm, a blood clot, deep vein thrombosis, venous stasis disease, phlebitis, varicose veins etc.), angiogenesis, atherosclerosis, a cardiovascular disease or disorder, a disease or disorder associated with impaired blood vessel formation, a disease or disorder associated with impaired cell signaling, a disease or disorder associated with impaired kinase activity, and a disease or disorder associated with impaired uptake of glucose into adipocytes.

In a specific embodiment, the synthetic RNA targets a member of the VEGF family. In some embodiments, the target is one or more of VEGF-A (including all isoforms, e.g. VEGF121, VEGF165 and VEGF189), placenta growth factor (PGF, including all isoforms, e.g. PGF-1, PGF-2, and PGF-3), VEGF-B, VEGF-C and VEGF-D, and any variants thereof (see, e.g. U.S. Pat. No. 9,078,860, the entire contents of which are hereby incorporated by reference). In some embodiments, the synthetic RNA targets a cognate receptor of any of the above VEGFs. The present invention also encompasses as targets VEGF-related proteins including orf virus-encoded VEGF-like proteins referred to as VEGF-E and a series of snake venoms referred to as VEGF-F. VEGFs and VEGF-related proteins are members of the Platelet Derived Growth Factor (PDGF) supergene family of cystine knot growth factors. All members of the PDGF supergene family share a high degree of structural homology with PDGF.

In various embodiments, the present invention relates to targeting a VEGF family member to treat diseases and conditions associated with angiogenesis, including but not limited to, solid tumor cancers, hemangiomas, rheumatoid arthritis, osteoarthritis, septic arthritis, asthma, atherosclerosis, idiopathic pulmonary fibrosis, vascular restenosis, arteriovenous malformations, meningiomas, neovascular glaucoma, psoriasis, Kaposi's Syndrome, angiofibroma, hemophilic joints, hypertrophic scars, Osler-Weber syndrome, pyogenic granuloma, retrolental fibroplasias, scleroderma, trachoma, von Hippel-Lindau disease, vascular adhesion pathologies, synovitis, dermatitis, neurological degenerative diseases, preeclampsia, unexplained female infertility, endometriosis, unexplained male infertility, pterygium, wounds, sores, skin ulcers, gastric ulcers, and duodenal ulcers. In various embodiments, the present invention relates to targeting a VEGF family member to treat angiogenesis-associated eye diseases, including without limitation any eye disease associated with abnormal intraocular neovascularization, including but not limited to retinopathy of prematurity, diabetic retinopathy, retinal vein occlusion, and age-related macular degeneration, as well diabetic macular edema and retinal vein occlusion. In an embodiment, the present compositions and methods relate to the treatment of wet age-related macular degeneration.

In a specific embodiment, the synthetic RNA targets a member of the interleukin family. The interleukins represent a large group of cytokines with diverse functions and were first characterized by expression in leukocytes and have since been shown to be expressed in a wide variety of cells, for example macrophages, TH-1 and TH-2 cells, T-lymphocytes, monocytes and bone marrow stroma. Broadly, the function of the immune system depends in a large part on the expression and function of the interleukins. In some embodiments, the target is one or more of interleukins 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 35 and 36, and, within each species of interleukin, various isotypes and/or interleukin receptors (e.g., IL-1R, IL-2R, IL-3R, IL-4R, IL-5R, IL-6R, IL-7R, IL-8R, IL-9R, IL-10R, IL-11R, IL-12R, IL-13R, IL-14R, IL-15R, IL-16R, IL-17R, IL-18R, IL-19R, IL-20R, IL-21R, IL-22R, IL-23R, IL-24R, IL-25R, IL-26, IL-27R, IL-28R, IL-29R, IL-30R, IL-31R, IL-32R, IL-33R, IL-34R, IL-35R, and IL-36R). In a specific embodiment, both IL-15 and IL-15R (e.g., IL-15RA) are targeted. Without wishing to be bound by theory, it is believed that the targeting of both interleukin (e.g., IL-15) and its cognitive interleukin receptor (e.g., IL-15RA) results in synergistic beneficial effects. In various embodiments, the present invention relates to targeting a member of the interleukin family to treat cancer, inflammatory, respiratory, autoimmune, cardiovascular, neurological, metabolic, and/or proliferative diseases, disorders, and/or conditions in a subject or organism, as described herein. In a specific embodiment, the present invention relates to targeting a member of the interleukin family to treat cancer. In a specific embodiment, the present invention relates to targeting a member of the interleukin family to treat rheumatoid arthritis.

In a specific embodiment, the synthetic RNA targets an EPO gene or a derivative thereof (e.g. SEQ ID NO: 164, SEQ ID NO: 165, SEQ ID NO: 166, and SEQ ID NO: 167). Some embodiments are related to NOVEPOETIN protein (SEQ ID NO: 167). Other embodiments are related to NOVECRIT (SEQ ID NO: 168).

Erythropoietin can stimulate erythropoiesis in anemic patients with chronic renal failure in whom the endogenous production of erythropoietin is impaired. Without being bound by theory, because of the length of time often required for erythropoiesis (several days for erythroid progenitors to mature and be released into the circulation), a clinically significant increase in hemoglobin is usually not observed in less than two weeks and may require up to ten weeks in some patients. The present methods and compositions provide, in some embodiments, more rapid therapeutic effect. The present methods and compositions provide, in some embodiments, more rapid therapeutic effect, for instance, when compared to wild type EPO and/or EPO without non-canonical nucleotides and/or EPO delivered as a protein biologic. The present methods and compositions provide, in some embodiments, a sustained therapeutic effect. The present methods and compositions provide, in some embodiments, a sustained therapeutic effect, for instance, when compared to wild type EPO and/or EPO without non-canonical nucleotides and/or EPO delivered as a protein biologic.

For instance, for EPO, the present methods and compositions provide a clinically significant increase in hematocrit in less than about 6 weeks, or less than about 5 weeks, or less than about 4 weeks, or less than about 3 weeks, or less than about 2 weeks, or less than about 1 week. In some embodiments, the present methods and compositions provide a clinically significant increase in hematocrit in about 2 weeks, or about 10 days, or about 1 week, or about 3 days, or about 1 day. In various embodiments, the present methods and compositions accelerate the process by which erythroid progenitors mature and are released into the circulation.

In some embodiments, the present EPO-related compositions find use in decreasing the dose and/or frequency of administration when compared to wild type EPO and/or EPO without non-canonical nucleotides and/or EPO delivered as a protein biologic. For instance, the present EPO-related compositions may find use in treatment regimens for the diseases disclosed herein (including, without limitation, one or more anemias) that involve administration on a monthly, or biweekly, or weekly basis. In some embodiments, therefore, the present EPO-related compositions reduce the need for daily, or, in some embodiments, weekly, administration. In some embodiments, the present EPO-related compositions require lower maintenance doses as compared to wild type EPO and/or EPO without non-canonical nucleotides and/or EPO delivered as a protein biologic. Certain embodiments are particularly useful for treating chemotherapy-induced anemia. Other embodiments are particularly useful for treating anemia associated with inflammation, including, but not limited to, rheumatoid arthritis.

In some embodiments, the present the present methods and compositions provide a fast and robust response that obviates the need for RBC transfusion. For instance, in some embodiments, the present methods and compositions allow for treatment of patients do not consent to transfusions.

In some embodiments, the present methods and compositions increase the rate of increase in hematocrit. In some embodiments, the present methods and compositions maintain elevated hematocrits (e.g. of 25%, or 30%, or 35%, or 40% or more) for a sustained period (e.g. about 1 month, or about 2 months, or about 3 months, or about 4 months, or about 5 months, or about 6 months, or about 9 months).

In some embodiments, the present methods and compositions stimulate red blood cell production. In some embodiments, the present methods and compositions stimulate division and differentiation of committed erythroid progenitors in the bone marrow.

In some embodiments, including, without limitation, when targeting EPO, the present invention relates to the treatment of one or more of anemia, including anemia resulting from resulting from chronic kidney disease (e.g. from dialysis) and/or chemotherapy and/or HIV treatment (e.g. Zidovudine (INN) or azidothymidine (AZT)), inflammatory bowel disease (e.g. Crohn's disease and ulcer colitis), anemia linked to inflammatory conditions (e.g. arthritis, lupus, IBD), anemia linked to diabetes, schizophrenia, cerebral malaria, as aplastic anemia, and myelodysplasia from the treatment of cancer (e.g. chemotherapy and/or radiation), and various myelodysplastic syndrome diseases (e.g. sickle cell anemia, hemoglobin SC disease, hemoglobin C disease, alpha- and beta-thalassemias, neonatal anemia after premature birth, and comparable conditions).

In some embodiments, including, without limitation, when targeting EPO, the present invention relates to the treatment of, or a patient having one or more of cancer, heart failure, autoimmune disease, sickle cell disease, thalassemia, blood loss, transfusion reaction, diabetes, vitamin B12 deficiency, collagen vascular disease, Shwachman syndrome, thrombocytopenic purpura, Celiac disease, endocrine deficiency state such as hypothyroidism or Addison's disease, autoimmune disease such as Crohn's Disease, systemic lupus erythematosis, rheumatoid arthritis or juvenile rheumatoid arthritis, ulcerative colitis immune disorders such as eosinophilic fasciitis, hypoimmunoglobulinemia, or thymoma/thymic carcinoma, graft vs. host disease, preleukemia, Nonhematologic syndrome (e.g. Down's, Dubowwitz, Seckel), Felty syndrome, hemolytic uremic syndrome, myelodysplasic syndrome, nocturnal paroxysmal hemoglobinuria, osteomyelofibrosis, pancytopenia, pure red-cell aplasia, Schoenlein-Henoch purpura, malaria, protein starvation, menorrhagia, systemic sclerosis, liver cirrhosis, hypometabolic states, congestive heart failure, chronic infections such as HIV/AIDS, tuberculosis, oseomyelitis, hepatitis B, hepatitis C, Epstein-barr virus or parvovirus, T cell leukemia virus, bacterial overgrowth syndrome, fungal or parasitic infections, and/or red cell membrane disorders such as hereditary spherocytosis, hereditary elliptocytosis, heriditray pyrpoikilocytosis, hereditary stomatocytosis, red cell enzyme defects, hypersplenism, immune hemolysis or paroxysmal nocturnal hemoglobinuria.

In some embodiments, including, without limitation, when targeting EPO, the present invention relates to the treatment of, or a patient having anemia, i.e. a condition in which the number of red blood cells and/or the amount of hemoglobin found in the red blood cells is below normal. In various embodiments, the anemia may be acute or chronic. For example, the present anemias include but are not limited to iron deficiency anemia, renal anemia, anemia of chronic diseases/inflammation, pernicious anemia such as macrocytic achylic anemia, juvenile pernicious anemia and congenital pernicious anemia, cancer-related anemia, chemotherapy-related anemia, radiotherapy-related anemia, pure red cell aplasia, refractory anemia with excess of blasts, aplastic anemia, X-lined sideroblastic anemia, hemolytic anemia, sickle cell anemia, anemia caused by impaired production of ESA, myelodysplasia syndromes, hypochromic anemia, microcytic anemia, sideroblastic anemia, autoimmune hemolytic anemia, Cooley's anemia, Mediterranean anemia, Diamond Blackfan anemia, Fanconi's anemia and drug-induced immune hemolytic anemia. Anemia may cause serious symptoms, including hypoxia, chronic fatigue, lack of concentration, pale skin, low blood pressure, dizziness and heart failure.

In some embodiments, the anemia is induced by chemotherapy is one cause of anemia. For instance, the chemotherapy may be any myelosuppressive chemotherapy. In some embodiments, the chemotherapy is one or more platinum-based drugs including cisplatin (e.g. PLATINOL) and carboplatin (e.g. PARAPLATIN). In some embodiments, the chemotherapy is any one of the agents described herein. In some embodiments, the chemotherapy is any agent described in Groopman et al. J Natl Cancer Inst (1999) 91 (19): 1616-1634, the contents of which are hereby incorporated by reference in their entireties. In some embodiments, the present compositions and methods are used in the treatment of chemotherapy-related anemia in later stage cancer patients (e.g. a stage IV, or stage III, or stage II cancer). In some embodiments, the present compositions and methods are used in the treatment of chemotherapy-related anemia in cancer patients receiving dose-dense chemotherapy or other aggressive chemotherapy regimens.

In some embodiments, the present invention relates to the treatment of anemia in a patient having one or more blood-based cancers, such as leukemia, lymphoma, and multiple myeloma. Such cancers may affect the bone marrow directly. Further, the present invention relates to metastatic cancer that has spread to the bone or bone marrow. In some embodiments, the present invention relates to the treatment of anemia in a patient undergoing radiation therapy. Such radiation therapy may damage the bone marrow, lowering its ability to make red blood cells. In further embodiments, the present invention relates to the treatment of anemia in a patient having a reduction or deficiency of one or more of iron, vitamin B12, and folic acid. In further embodiments, the present invention relates to the treatment of anemia in a patient having excessive bleeding including without limitation, after surgery or from a tumor that is causing internal bleeding. In further embodiments, the present invention relates to the treatment of anemia in a patient having anemia of chronic disease.

In some embodiments, the present invention relates to the treatment of anemia resulting from chronic renal failure. In some embodiments, the present invention relates to the treatment of anemia resulting from the use of one or more renal replacement therapies, inclusive of dialysis, hemodialysis, peritoneal dialysis, hemofiltration, hemodiafiltration, and renal transplantation.

In some embodiments, the present invention relates to the treatment of anemia in patients with chronic kidney disease who are not on dialysis. For instance, the present invention relates to patients in stage 1 CKD, or stage 2 CKD, or stage 3 CKD, or stage 4 CKD, or stage 5 CKD. In some embodiments, the present patient is stage 4 CKD or stage 5 CKD. In some embodiments, the present patient has undergone a kidney transplant. In some embodiments, the present invention relates to the treatment of anemia is a patient having an acute kidney injury (AKI).

In various embodiments, the present compositions and methods are used to reduce or eliminate fatigue, dizziness, and shortness of breath in a patient.

In various embodiments, the present compositions and methods are used to treat a patient presenting with hyporesponse or resistance to erythropoiesis stimulating agent therapy. In some embodiments, hyporesponsiveness to erythropoietin or ESA-resistant anemia refers to the presence of at least one of the following conditions: i) a significant decrease in hemoglobin levels at a constant dose of ESA treatment, ii) a significant increase in the ESA dose requirement to achieve or maintain a certain hemoglobin level, iii) a failure to raise the hemoglobin level to the target range despite the ESA dose equivalent to erythropoietin greater than 150 IU/kg/week or 0.75 mg/kg/week of darbepoeitn-alpha or continued need for such high dose of ESA to maintain the target hemoglobin level. For example, approximately 5-10% of patients with CDK demonstrate hyporesponsiveness to ESA, defined as a continued need for greater than 300 IU/kg per week erythropoietin or 1.5 ng/kg per week darbepoetin administered by the subcutaneous route.

In various embodiments, the present compositions and methods mitigate the need for dose-escalation of the erythropoiesis stimulating agent therapy and therefore, optionally, avoid side effects (e.g. flu-like symptoms such as joint pains, weakness, dizziness and tiredness, skin irritation, increased risk of adverse cardiovascular complications).

In various embodiments, the present compositions and methods are used to maintain a hemoglobin level of about 12.5 to 13 g/dL. In various embodiments, the present compositions and methods are used in patients having hemoglobin levels of below about 12 g/dL, or about 11 g/dL, or about 10 g/dL, or about 9 g/dL, or about 8 g/dL, or about 7 g/dL, or about 6 g/dL, or about 5 g/dL. In various embodiments, the present compositions and methods are used in patients having iron blood test scores that indicate blood pathology, e.g. a ferritin score of below about 200 ng/L and/or a transferrin saturation score below about 30%.

In various embodiments, the present compositions and methods are used to increase or maintain hemoglobin levels at a target level ranging from 9 to 10 g/dL, at a target level ranging from 9 g/dL to 11 g/dL, at a target level ranging from 9 g/dL to 12 g/dL, at a target level ranging from 9 g/dL to 14 g/dL, at a target level ranging from 10 g/dL to 14 g/dL, or at a target level ranging from 12 g/dL to 14 g/dL.

In various embodiments, the present compositions and methods are used to bring a patient's hemoglobin levels to normal. In various embodiments, normal hemoglobin ranges for humans are about 14-18 g/dl for men and 12-16 for women g/dl with the average hemoglobin value for men at about 16 g/dL and for women at about 14 g/dL.

In some embodiments, for instance when targeting EPO, the present invention relates to the treatment of anemia of one or more of the following toxicity grading criteria (e.g. NCI Common Toxicity Criteria): grade 1 (mild), 10.0 g hemoglobin/dL to within normal limits; grade 2 (moderate), 8.0-10.0 g of hemoglobin/dL; grade 3 (serious or severe), 6.5-7.9 g of hemoglobin/dL; and grade 4 (life threatening), less than 6.5 g of hemoglobin/dL. In various embodiments, the present invention brings an increase in toxicity grading criteria by about 1 point, or about 2 points, or about 3 points, or about 4 points. In various embodiments, the present invention results in a patient having a level of 0 or 1. In various embodiments, the present compositions and methods improve anemia as assessed by one or more scales described in Groopman et al. J Natl Cancer Inst (1999) 91 (19): 1616-1634, the entire contents of which are hereby incorporated by reference in their entireties.

In some embodiments, when targeting EPO, the present invention relates to combination therapy with one or more EPOs. For example, the present compositions may provide a sustained effect that can supplement a fast action of another EPO. In some embodiments, the present compositions are used as an adjuvant to other EPOs. In some embodiments, the present compositions are used as a maintenance therapy to other EPOs Other EPOs include the following: epoetin alfa, including without limitation, DARBEPOETIN (ARANESP), EPOCEPT (LUPIN PHARMA), NANOKINE (NANOGEN PHARMACEUTICAL), EPOFIT (INTAS PHARMA), EPOGEN (AMGEN), EPOGIN, EPREX, (JANSSEN-CILAG), BINOCRIT (SANDOZ), PROCRIT; epoetin beta, including without limitation, NEORECORMON (HOFFMANN-LA ROCHE), RECORMON, Methoxy polyethylene glycol-epoetin beta (MIRCERA, ROCHE); epoetin delta, including without limitation, DYNEPO (erythropoiesis stimulating protein, SHIRE PLC); epoetin omega, including without limitation, EPOMAX; epoetin zeta, including without limitation, SILAPO (STADA) and RETACRIT (HOSPIRA) and other EPOs, including without limitation, EPOCEPT (LUPIN PHARMACEUTICALS), EPOTRUST (PANACEA BIOTEC LTD), ERYPRO SAFE (BIOCON LTD.), REPOITIN (SERUM INSTITUTE OF INDIA LIMITED), VINTOR (EMCURE PHARMACEUTICALS), EPOFIT (INTAS PHARMA), ERYKINE (INTAS BIOPHARMACEUTICA), WEPDX (WOCKHARDT BIOTECH), ESPOGEN (LG LIFE SCIENCES), RELIPOIETIN (RELIANCE LIFE SCIENCES), SHANPOIETIN (SHANTHA BIOTECHNICS LTD), ZYROP (CADILA HEALTHCARE LTD.), EPIAO (RHUEPO) (SHENYANG SUNSHINE PHARMACEUTICAL CO. LTD), CINNAPOIETIN (CINNAGEN).

In some embodiments, when targeting EPO, the present invention relates to combination therapy with a blood transfusion. For instance, the present compositions may supplement a blood transfusion. In some embodiments, when targeting EPO, the present invention relates to combination therapy with iron supplements.

In some embodiments, the present invention also relates to the following protein targets, e.g. in the treatment of disease: growth hormone (GH) e.g. human and bovine growth hormone, growth hormone-releasing hormones; interferon including $\alpha$-, $\beta$-, or $\gamma$-interferons, etc., interleukin-I; interleukin-II; erythropoietin including $\alpha$- and $\beta$-erythropoietin (EPO), granulocyte colony stimulating factor (GCSF), granulocyte macrophage colony stimulating factor (GM-CSF), anti-agiogenic proteins (e.g., angiostatin, endostatin) PACAP polypeptide (pituitary adenylate cyclase activating polypeptide), vasoactive intestinal peptide (VIP), thyrotrophin releasing hormone (TRH), corticotropin releasing hormone (CRH), vasopressin, arginine vasopressin (AVP), angiotensin, calcitonin, atrial naturetic factor, somatostatin, adrenocorticotropin, gonadotropin releasing hormone, oxytocin, insulin, somatotropin, plasminogen tissue activator, coagulation factors including coagulation factors VIII and IX, glucosylceramidases, sargramostim, lenograstin, filgrastin, dornase-$\alpha$, molgramostim, PEG-L-asparaginase, PEG-adenosine deaminase, hirudin, eptacog-$\alpha$ (human blood coagulation factor Vila) nerve growth factors, transforming growth factor, epidermal growth factor, basic fibroblast growth factor, VEGF; heparin including low molecular weight heparin, calcitonin; antigens; monoclonal antibodies; vancomycin; desferrioxamine (DFO); parathyroid hormone, an immunogen or antigen, and an antibody such as a monoclonal antibody.

In some embodiments, the present methods allow for effective additional therapeutic agent (e.g. those described herein) activity and/or targeting to a cell and/or tissue of interest. For example, the present synthetic RNA can lead to increased expression of one or more targeting molecules that direct an additional therapeutic to the location of therapy. For example, the additional therapeutic agent may have a binding partner that the synthetic RNA encodes. For example, the synthetic RNA may induce the expression of an antigen that directs the therapeutic activity of an antibody that may be used in combination (e.g. herceptin, rituxan, campath, gemtuzumab, herceptin, panorex, rituximab, bexxar, edrecolomab, alemtuzumab, mylotrag, IMC-C225, smartin 195, and mitomomab). In some embodiments, the synthetic RNA can be injected directly into one or more of the tumors described herein and home the therapeutic antibody to the tumor.

In some embodiments, the present methods allow for effective additional therapeutic agent generation, especially when the additional therapeutic agent is a prodrug, for example, to produce an active form of the drug. In some embodiments, the synthetic RNA can be injected directly into one or more of the tumors described herein and home the prodrug to the tumor. For instance, the synthetic RNA may encode an enzyme that catalyzes the localized conversion of a non-toxic, systemically delivered agent into a potent chemotherapeutic agent. By way of illustration (note that any of the prodrugs or drugs listed herein are additional agents as used herein):

| Enzyme | Prodrug | Drug |
| --- | --- | --- |
| aldehyde oxidases | 5-Ethynyl-2(1H)-pyrimidinone | 5-Ethynyluracil |
| aldehyde oxidases | IPdR | IUdR |
| aldehyde oxidases | 5-FP | 5-FU |
| amino acid oxidases | d-alanine | Hydrogen peroxide |
| amino acid oxidases | SeCys conjugates | Selenols and hydrogen peroxide |
| cytochrome P450 reductase | Menadione | Semiquinone radical |
| cytochrome P450 reductase | Mitomycin C | Quinone methide intermediate |
| cytochrome P450 reductase | Tirapazamine | Nitroxide radical |
| cytochrome P450 reductase | EO9 | Unidentified semiquinone radical |
| DT-diaphorase | Streptonigrin | Unidentified |
| DT-diaphorase | Mitomycin C | Quinone methide intermediate |
| DT-diaphorase | CB 1954 | 5-(Aziridin-1-yl)-4-hydroxyl-amino-2-nitrobenzamide |
| DT-diaphorase | Diaziquone | Semiquinone radical$^a$ |
| cytochrome P450 | Ipomeanol | Unidentified (possibly furan epoxide) |
| cytochrome P450 | Ftorafur (tegafur) | 5-FU |
| cytochrome P450 | Dacarbazine | HHMTIC |
| cytochrome P450 | Trofosfamide | Trofosfamide mustard |
| cytochrome P450 | Ifosfamide | Isophosphamide mustard |
| cytochrome P450 | Cyclophosphamide | Phosphoramide mustard |
| cytochrome P450 | AQ4N | AQ4 |
| tyrosinase | 2,4-Dihydroxyphenylalanine | 6-Hydroxydopa |
| tyrosinase | 4-S-CAP | BQ |
| tyrosinase | GHB | GBQ |
| tyrosinase | Substituted phenols | Orthoquinones |
| tyrosinase | Phenyl mustards | Phenol mustard |
| tyrosinase | Urea mustards | Unidentified |
| glutathione S-transferase | TER286 | Aziridinium agent |
| glutathione S-transferase | S-CPHC-ethylsulfoxide | S-CPHC-glutathione |
| glutathione S-transferase | PTA | 6-MP |
| carboxylesterase | CPT-11 | SN-38 |
| carboxylesterase | Paclitaxel-2-ethylcarbonate | Paclitaxel |
| carboxylesterase | Capecitabine | 5'-Deoxy-5-fluorocytidine (5-FU) |
| carboxylesterase | Tertiary amidomethyl esters | Carboxylic acids and amines$^a$ |
| alkaline phosphatase | Amifostine | WR-1065 |
| alkaline phosphatase | 3-AP phosphate | 3-AP |
| β-glucuronidase | BHAMG | pHAM |
| β-glucuronidase | Epirubicin-glucuronide | Epirubicin |
| β-glucuronidase | HMR 1826 | Doxorubicin |
| β-glucuronidase | DNR-GA3 | Daunorubicin |
| β-glucuronidase | DOX-GA3 | Doxorubicin |
| β-glucuronidase | Paclitaxel glucuronide | Paclitaxel |
| β-glucuronidase | 5-FU glucuronide | 5-FU |
| cysteine conjugate β-lyase | PC | 6-MP |
| cysteine conjugate β-lyase | GC | 6-Thioguanine |
| cysteine conjugate β-lyase | SeCys conjugate | Selenol |
| Nitroreductase | CB 1954 | 5-(Aziridin-1-yl)-4-hydroxyl-amino-2-nitro-benzamide |
| Cytochrome P450 | 4-Ipomeanol | Unidentified (furan epoxide is speculated) |
| Cytochrome P450 | Ifosfamide | Isophosphoramide mustard |
| Cytochrome P450 | Cyclophosphamide | Phosphoramide mustard |
| Purine-nucleoside phosphorylase | Fludarabine | 2-Fluoroadenine |
| Purine-nucleoside phosphorylase | MeP-dR | MeP |
| Thymidine kinase | Ganciclovir | Ganciclovir-triphosphate nucleotide |
| Alkaline phosphatase | Etoposide phosphate | Etoposide |
| Alkaline phosphatase | Mitomycin C phosphate | Mitomycin C |
| Alkaline phosphatase | POMP | POM |
| Alkaline phosphatase | N-(4-phosphonooxy)-phenylacetyl)doxorubicin | Doxorubicin |
| β-Glucuronidase | Glucuronidated Nornitrogen mustard | Oxazolidinone |
| β-Glucuronidase | Glucuronidated 9-amino-camptothecin | 9-Aminocamptothecin |
| β-Glucuronidase | Glucuronide mustard | Mustard |
| Carboxypeptidase | Methotrexate-amino acids | Methotrexate |
| Carboxypeptidase | CMDA | Benzoic acid mustard |

| Enzyme | Prodrug | Drug |
|---|---|---|
| Penicillin amidase | DPO | Doxorubicin |
| Penicillin amidase | MelPO | Melphalan |
| Penicillin amidase | NHPAP | Palytoxin |
| Penicillin amidase | N-(phenylacetyl) doxorubicin | Doxorubicin |
| Penicillin amidase | N-(phenylacetyl) melphalan | Melphalan |
| β-Lactamase | LY 266070 | DAVLBHYD |
| β-Lactamase | C-DOX | Doxorubicin |
| β-Lactamase | PRODOX | Doxorubicin |
| β-Lactamase | CM | Phenylenediamine mustard |
| β-Lactamase | CCM | Phenylenediamine mustard |
| β-Lactamase | Cephalosporin-DACCP | DACCP |
| β-Lactamase | PROTAX | Taxol |
| β-Lactamase | Cephalosporin mitomycin C | Mitomycin C |
| β-Lactamase | C-Mel | Melphalan |
| Cytosine deaminase | 5-Fluorocytosine | 5-Fluorouracil |
| Methionine γ-lyase | Selenomethionine | Methylselenol |
| Methionine γ-lyase | Trifluoromethionine | $CSF_2$ |

In certain embodiments, the synthetic RNA may encode an enzyme that catalyzes the conversion of 5-FU and/or Doxorubicin from various prodrugs, as illustrated by the examples below:

| 5-FU Prodrugs and Enzymes | |
|---|---|
| 5-FP | Aldehyde oxidase |
| Ftorafur | P450 |
| 5'-DFUR | Thymidine phosphorylase |
| 5-FU glucuronide | β-Glucuronidase |
| 5-FC | Cytosine deaminase |
| Doxorubicin Prodrugs and Enzymes | |
| N-(4-phosphono-oxy)-phenylacetyl) doxorubicin | Alkaline phosphatase |
| HMR 1826 | β-Glucuronidase |
| DOX-GA3 | β-Glucuronidase |
| DPO | Penicillin amidase |
| N-(phenyacetyl) doxorubicin | Penicillin amidase |
| C-DOX | β-Lactamase |
| PRODOX | β-Lactamase |

In some embodiments, the nucleic acid drugs at the doses and regimens described herein may be used in combination with one or more additional agents (aka adjuvant therapy or combination agent). In some embodiments, the nucleic acid drugs at the doses and regimens described herein may be used in a human patient undergoing treatment with one or more additional agents. In some embodiments, the nucleic acid drug is used as an adjuvant or neoadjuvant to any of the additional agents described herein. In some embodiments, the invention pertains to co-administration and/or co-formulation. Any of the compositions described herein may be co-formulated and/or co-administered. In some embodiments, any nucleic acid drug described herein acts synergistically when co-administered with another agent and may be administered at doses that are lower than the doses commonly employed when such agents are used as monotherapy.

In some embodiments, any nucleic acid drug described herein may include derivatives that are modified, i.e., by the covalent attachment of any type of molecule to the composition such that covalent attachment does not prevent the activity of the composition. For example, but not by way of limitation, derivatives include composition that have been modified by, inter alia, glycosylation, lipidation, acetylation, pegylation, phosphorylation, amidation, derivatization by known protecting/blocking groups, proteolytic cleavage, linkage to a cellular ligand or other protein, etc. Any of numerous chemical modifications can be carried out by known techniques, including, but not limited to specific chemical cleavage, acetylation, formylation, metabolic synthesis of turicamycin, etc. Additionally, the derivative can contain one or more non-classical amino acids. In various embodiments, one or more additional agents (aka adjuvant therapy or combination agent) may be conjugated to any nucleic acid drug described herein.

Contacting a cell with a steroid can suppress the innate immune response to foreign nucleic acids, and can increase the efficiency of nucleic acid delivery and translation. Certain embodiments are therefore directed to contacting a cell with a steroid. Other embodiments are directed to administering a steroid to a patient. Illustrative steroids include corticosteroid steroids. In some embodiments, the steroid is one or more of cortisone, hydrocortisone, prednisone, prednisolone, dexamethasone, triamcinolone, and betamethasone. In one embodiment, the steroid is hydrocortisone. In another embodiment, the steroid is dexamethasone.

Other embodiments are directed to administering to a patient a member of the group: an antibiotic, an antimycotic, and an RNAse inhibitor.

Botulinum toxin type A has been approved by the US Food and Drug Administration (FDA) for the treatment of essential blepharospasm, strabismus and hemifacial spasm in patients over the age of twelve, cervical dystonia, glabellar line (facial) wrinkles and for treating hyperhidrosis and botulinum toxin type B has been approved for the treatment of cervical dystonia. The present compositions may be combined with these toxins in the treatment of these diseases and related diseases. Some embodiments are directed to a nucleic acid drug targeting a neurotoxin. In various embodiments, the neurotoxin is a botulinum toxin or a biologically active fragment, variant, analogue or family-member thereof.

Further the combination of any one of the aforementioned toxins may be used in combination with the present compositions for various cosmetic procedures, including, without limitation, facial wrinkles, hyperkinetic skin lines, glabellar lines, crow's feet, marionette lines, skin disorders, nasolabial folds, blepharospasm, strabismus, hemifacial spasms and sweating disorders. Alternatively, the present compositions may be used to in these cosmetic procedures as a monotherapy.

Certain embodiments are directed to a combination therapy comprising one or more of the therapeutic or cosmetic compositions of the present invention and one or more adjuvant therapies or cosmetic treatments. In certain embodiments, one or more of the therapeutic or cosmetic compositions of the present invention are administered to a subject which is undergoing treatment with one or more adjuvant therapies or cosmetic treatments. Example adjuvant therapies and cosmetic treatments are set forth in Table 3 and Table 5 of U.S. Provisional Application No. 61/721, 302, the contents of which are hereby incorporated by reference, and are given by way of example, and not by way of limitation.

(CCNU), 1-methylnitrosourea, cyclothosphamide, mechlorethamine, busulfan, dibromomannitol, streptozotocin, mitomycin C, cis-dichlorodiamine platinum (II) (DDP) cisplatin and carboplatin (paraplatin); anthracyclines include daunorubicin (formerly daunomycin), doxorubicin (adridaunorubicin (formerly daunomycin), doxorubicin (adriamycin), detorubicin, carminomycin, idarubicin, epirubicin, mitoxantrone and bisantrene; antibiotics include dactinomycin (actinomycin D), bleomycin, calicheamicin, mithramycin, and anthramycin (AMC); and antimytotic agents such as the vinca alkaloids, vincristine and vinblas-

TABLE 3

Illustrative Adjuvant Therapies

| Therapy/Treatment Class | Disease/Condition | Example Therapy/Treatment |
|---|---|---|
| Acetylcholinesterase inhibitors | Myasthenia gravis, Glaucoma, Alzheimer's disease, Lewy body dementia, Postural tachycardia syndrome | Edrophonium |
| Angiotensin-converting-enzyme inhibitor | Hypertension, Congestive heart failure | Perindopril |
| Alkylating agents | Cancer | Cisplatin |
| Angiogenesis inhibitors | Cancer, Macular degeneration | Bevacizumab |
| Angiotensin II receptor antagonists | Hypertension, Diabetic nephropathy, Congestive heart failure | Valsartan |
| Antibiotics | Bacterial infection | Amoxicillin |
| Antidiabetic drugs | Diabetes | Metformin |
| Antimetabolites | Cancer, Infection | 5-fluorouracil (5FU) |
| Antisense oligonucleotides | Cancer, Diabetes, Amyotrophic lateral sclerosis (ALS), Hypercholesterolemia | Mipomersen |
| Cytotoxic antibiotics | Cancer | Doxorubicin |
| Deep-brain stimulation | Chronic pain, Parkinson's disease, Tremor, Dystonia | N/A |
| Dopamine agonists | Parkinson's disease, Type II diabetes, Pituitary tumors | Bromocriptine |
| Entry/Fusion inhibitors | HIV/AIDS | Maraviroc |
| Glucagon-like peptide-1 agonists | Diabetes | Exenatide |
| Glucocorticoids | Asthma, Adrenal insufficiency, Inflammatory diseases, Immune diseases, Bacterial meningitis | Dexamethasone |
| Immunosuppressive drugs | Organ transplantation, Inflammatory diseases, Immune diseases | Azathioprine |
| Insulin/Insulin analogs | Diabetes | NPH insulin |
| Integrase inhibitors | HIV/AIDS | Raltegravir |
| MAO-B inhibitors | Parkinson's disease, Depression, Dementia | Selegiline |
| Maturation inhibitors | HIV/AIDS | Bevirimat |
| Nucleoside analog reverse-transcriptase inhibitors | HIV/AIDS, Hepatitis B | Lamivudine |
| Nucleotide analog reverse-transcriptase inhibitors | HIV/AIDS, Hepatitis B | Tenofovir |
| Non-nucleoside reverse-transcriptase inhibitors | HIV/AIDS | Rilpivirine |
| Pegylated interferon | Hepatitis B/C, Multiple sclerosis | Interferon beta-1a |
| Plant alkaloids/terpenoids | Cancer | Paclitaxel |
| Protease inhibitors | HIV/AIDS, Hepatitis C, Other viral infections | Telaprevir |
| Radiotherapy | Cancer | Brachytherapy |
| Renin inhibitors | Hypertension | Aliskiren |
| Statins | Hypercholesterolemia | Atorvastatin |
| Topoisomerase inhibitors | Cancer | Topotecan |
| Vasopressin receptor antagonist | Hyponatremia, Kidney disease | Tolvaptan |
| Dermal filler | Wrinkles, aged skin | Hyaluronic Acid |
| Botulinum toxin | Wrinkles, aged skin | botulinum toxin type A |
| Induction of skin repair | Acne scars, aged skin | Laser treatment, dermabrasion |

In some embodiments, the additional agent is a cytotoxic agent, comprising, in illustrative embodiments, a toxin, a chemotherapeutic agent, a radioisotope, and an agent that causes apoptosis or cell death.

Illustrative cytotoxic agents include, but are not limited to, methotrexate, aminopterin, 6-mercaptopurine, 6-thioguanine, cytarabine, 5-fluorouracil decarbazine; alkylating agents such as mechlorethamine, thioepa chlorambucil, melphalan, carmustine (BSNU), mitomycin C, lomustine tine. Other cytotoxic agents include paclitaxel (taxol), ricin, pseudomonas exotoxin, gemcitabine, cytochalasin B, gramicidin D, ethidium bromide, emetine, etoposide, tenoposide, colchicin, dihydroxy anthracin dione, 1-dehydrotestosterone, glucocorticoids, procaine, tetracaine, lidocaine, propranolol, puromycin, procarbazine, hydroxyurea, asparaginase, corticosteroids, mytotane (O,P'-(DDD)), interferons, and mixtures of these cytotoxic agents.

Further cytotoxic agents include, but are not limited to, chemotherapeutic agents such as carboplatin, cisplatin, paclitaxel, gemcitabine, calicheamicin, doxorubicin, 5-fluorouracil, mitomycin C, actinomycin D, cyclophosphamide, vincristine, bleomycin, VEGF antagonists, EGFR antagonists, platins, taxols, irinotecan, 5-fluorouracil, gemcytabine, leucovorine, steroids, cyclophosphamide, melphalan, vinca alkaloids (e.g., vinblastine, vincristine, vindesine and vinorelbine), mustines, tyrosine kinase inhibitors, radiotherapy, sex hormone antagonists, selective androgen receptor modulators, selective estrogen receptor modulators, PDGF antagonists, TNF antagonists, IL-1 antagonists, interleukins (e.g. IL-12 or IL-2), IL-12R antagonists, Toxin conjugated monoclonal antibodies, tumor antigen specific monoclonal antibodies, Erbitux, Avastin, Pertuzumab, anti-CD20 antibodies, Rituxan, ocrelizumab, ofatumumab, DXL625, HERCEPTIN, or any combination thereof. Toxic enzymes from plants and bacteria such as ricin, diphtheria toxin and Pseudomonas toxin may be conjugated to the therapeutic agents (e.g. antibodies) to generate cell-type-specific-killing reagents (Youle, et al., Proc. Nat'l Acad. Sci. USA 77:5483 (1980); Gilliland, et al., Proc. Nat'l Acad. Sci. USA 77:4539 (1980); Krolick, et al., Proc. Nat'l Acad. Sci. USA 77:5419 (1980)).

Other cytotoxic agents include cytotoxic ribonucleases as described by Goldenberg in U.S. Pat. No. 6,653,104. Embodiments of the invention also relate to radioimmunoconjugates where a radionuclide that emits alpha or beta particles is stably coupled to the antibody, or binding fragments thereof, with or without the use of a complex-forming agent. Such radionuclides include beta-emitters such as Phosphorus-32, Scandium-47, Copper-67, Gallium-67, Yttrium-88, Yttrium-90, Iodine-125, Iodine-131, Samarium-153, Lutetium-177, Rhenium-186 or Rhenium-188, and alpha-emitters such as Astatine-211, Lead-212, Bismuth-212, Bismuth-213 or Actinium-225.

Illustrative detectable moieties further include, but are not limited to, horseradish peroxidase, acetylcholinesterase, alkaline phosphatase, beta-galactosidase and luciferase. Further exemplary fluorescent materials include, but are not limited to, rhodamine, fluorescein, fluorescein isothiocyanate, umbelliferone, dichlorotriazinylamine, phycoerythrin and dansyl chloride. Further exemplary chemiluminescent moieties include, but are not limited to, luminol. Further exemplary bioluminescent materials include, but are not limited to, luciferin and aequorin. Further exemplary radioactive materials include, but are not limited to, Iodine-125, Carbon-14, Sulfur-35, Tritium and Phosphorus-32.

The dosage of any additional agent described herein as well as the dosing schedule can depend on various parameters, including, but not limited to, the human patient's general health, and the administering physician's and/or human patient's discretion. Co-administration may be simultaneous or sequential. Any additional agent described herein, can be administered prior to (e.g., about 5 minutes, about 15 minutes, about 30 minutes, about 45 minutes, about 1 hour, about 2 hours, about 4 hours, about 6 hours, about 12 hours, about 24 hours, about 48 hours, about 72 hours, about 96 hours, about 1 week, about 2 weeks, about 3 weeks, about 4 weeks, about 5 weeks, about 6 weeks, 8 weeks, or about 12 weeks before), concurrently with, or subsequent to (e.g., about 5 minutes, about 15 minutes, about 30 minutes, about 45 minutes, about 1 hour, about 2 hours, about 4 hours, about 6 hours, about 12 hours, about 24 hours, about 48 hours, about 72 hours, about 96 hours, about 1 week, about 2 weeks, about 3 weeks, about 4 weeks, about 5 weeks, about 6 weeks, about 8 weeks, or about 12 weeks after) the administration of the nucleic acid drug to a human patient in need thereof. In various embodiments any agent described herein is administered about 1 minute apart, about 10 minutes apart, about 30 minutes apart, less than about 1 hour apart, about 1 hour apart, about 1 hour to about 2 hours apart, about 2 hours to about 3 hours apart, about 3 hours to about 4 hours apart, about 4 hours to about 5 hours apart, about 5 hours to about 6 hours apart, about 6 hours to about 7 hours apart, about 7 hours to about 8 hours apart, about 8 hours to about 9 hours apart, about 9 hours to about 10 hours apart, about 10 hours to about 11 hours apart, about 11 hours to about 12 hours apart, no more than about 24 hours apart or no more than about 48 hours apart.

In a specific embodiment, the combination regimen is designed to exploit the finding that the nucleic acid drug dosing and formulation of the present invention has potent effects quickly (e.g. in about 6, or about 12, or about 24, or about 30, or about 36, or about 48 hours) and the effects can last about 7 days, or longer.

The dose of a nucleic acid drug is disclosed herein. In general, the dose of any additional agent that is useful is known to those in the art. For example, doses may be determined with reference *Physicians' Desk Reference*, 66th Edition, PDR Network; 2012 Edition (Dec. 27, 2011), the contents of which are incorporated by reference in its entirety. In some embodiments, the present invention allows a patient to receive doses that exceed those determined with reference *Physicians' Desk Reference*. The dosage of any additional agent described herein can depend on several factors including the severity of the condition, whether the condition is to be treated or prevented, and the age, weight, and health of the human patient to be treated. Additionally, pharmacogenomic (the effect of genotype on the pharmacokinetic, pharmacodynamic or efficacy profile of a therapeutic) information about a particular human patient may affect dosage used. Furthermore, the exact individual dosages can be adjusted somewhat depending on a variety of factors, including the specific combination of the agents being administered, the time of administration, the route of administration, the nature of the formulation, the rate of excretion, the particular disease being treated, the severity of the disorder, and the anatomical location of the disorder. Some variations in the dosage can be expected.

Cells, tissues, organs, and organisms, including, but not limited to, humans, have several characteristics that can inhibit or prevent the delivery of nucleic acids, including, for example, the stratum corneum, which can serve as a barrier to foreign organisms and nucleic acids. These characteristics can thus inhibit the effects of therapeutics and cosmetics comprising nucleic acids. It has now been discovered that many of these characteristics can be circumvented or overcome using a patch comprising a flexible membrane and a plurality of needles, and that such a patch can serve as an effective and safe article for the delivery of nucleic acids. Certain embodiments are therefore directed to a nucleic acid delivery patch. In one embodiment, the nucleic acid delivery patch comprises a flexible membrane. In another embodiment, the nucleic acid delivery patch comprises a plurality of needles. In yet another embodiment, the plurality of needles are attached to the flexible membrane. In some embodiments, the patch comprises a nucleic acid. In one embodiment, the nucleic acid is present in solution. In one embodiment, the plurality of needles include one or more needles having a lumen. In another embodiment, the patch further comprises a second flexible membrane. In yet another embodiment, the flexible membrane and the second flexible membrane are arranged to form a cavity. In a further embodiment, the cavity contains a nucleic acid. In a still further embodiment, the membrane comprises one or more holes through which a nucleic acid can pass. In a still further embodiment, one or more holes and one or more needles having a lumen are arranged to allow the passage of a solution containing a nucleic acid through at least one of the one or more holes and through at least one of the one or more needles having a lumen. In some embodiments, the patch is configured to deliver a solution to the skin. In one embodiment, the solution comprises a nucleic acid. In another embodiment, the solution comprises a vehicle. In yet another embodiment, the vehicle is a lipid or lipidoid. In a still further embodiment, the vehicle is a lipid-based transfection reagent.

The cell membrane can serve as a barrier to foreign nucleic acids. It has now been discovered that combining the patch of the present invention with an electric field can increase the efficiency of nucleic acid delivery. Certain embodiments are therefore directed to a nucleic acid delivery patch comprising a plurality of needles, wherein at least two needles form part of a high-voltage circuit. Certain embodiments are directed to an implantable "tattoo" for microneedle delivery (see, e.g. Nature Materials 12, pp 367-376 (2013), the contents of which are hereby incorporated by reference in their entirety). In one embodiment, the high-voltage circuit generates a voltage greater than about 10V. In another embodiment, the high-voltage circuit generates a voltage greater than about 20V. In yet another embodiment, an electric field is produced between two of the needles. In a further embodiment, the magnitude of the electric field is at least about 100V/cm. In a still further embodiment, the magnitude of the electric field is at least about 200V/cm. In some embodiments, the patch is configured to deliver a nucleic acid to the epidermis. In other embodiments, the patch is configured to deliver a nucleic acid to the dermis. In still other embodiments, the patch is configured to deliver a nucleic acid to sub-dermal tissue. In still other embodiments, the patch is configured to deliver a nucleic acid to muscle. Certain embodiments are directed to a nucleic acid delivery patch comprising a plurality of electrodes. In one embodiment, the plurality of electrodes is attached to a flexible membrane. Other embodiments are directed to a nucleic acid delivery patch comprising a rigid structure. In one embodiment, a plurality of electrodes are attached to the rigid structure.

In some embodiments, the compositions described herein are administered using an array of needles covering an affected area of the subject. In some embodiments, the treatment area is mechanically massaged after administration. In some embodiments, the treatment area is exposed to electric pulses after administration. In some embodiments, the electric pulses are between about 10V and about 200V for from about 50 microseconds to about 1 second. In some embodiments, the electric pulses are generated around the treatment area by a multielectrode array.

In some embodiments, the present invention provides a patch delivery system, comprising a non-viral RNA transfection composition enclosed within a membrane, and an array of delivery needles delivering from about 10 ng to about 2000 ng of RNA per treatment area of about 100 $cm^2$ or less, or about 50 $cm^2$ or less, or about 10 $cm^2$ or less, or about 5 $cm^2$ or less, or about 1 $cm^2$ or less, or about 0.5 $cm^2$ or less, or about 0.2 $cm^2$ or less. In some embodiments, the non-viral transfection composition contains from about 10 ng to about 2000 ng per injection volume of about 20 μL to about 1 ml. In some embodiments, each needle delivers an injection volume of between 1 μL and 500 μL.

In some embodiments, the delivery patch comprises an acrylic reservoir that holds the nucleic acid drug. In some embodiments, a silicon adhesive is added to create a semi-solid suspension of microscopic, concentrated drug cells. Further, some embodiments pride a patch that is associated with one or more enhancers (these include, without limitation, iontophoresis, ultrasound, chemicals including gels, microneedles, sonophoresis, lasers, and electroporatic methods).

In some embodiments, the delivery is effected via a gel, optionally a hydro alcoholic gel containing a combination of enhancers (e.g. COMBIGEL (ANTARES PHARMA)).

In various embodiments, the RNA is delivered using needle arrays. Illustrative needle arrays include, but are not limited to AdminPen 600 and those described in U.S. Pat. Nos. 7,658,728, 7,785,301, and 8,414,548, the entire disclosure of which are hereby incorporated by reference. Other examples of needles include, for example, the 3M™ Hollow Microstructured Transdermal System and the 3M Solid Microstructured Transdermal Systems (sMTS). See, e.g. U.S. Pat. Nos. 3,034,507 and 3,675,766; Microneedles for Transdermal Drug Delivery. Advanced Drug Delivery Reviews. 56: 581-587 (2004); Pharm Res. 2011 January; 28(1): 31-40, the entire contents of which are hereby incorporated by reference in their entireties.

In some embodiments, microneedles and/or microneedle arrays may be used. In various embodiments, the microneedles and/or microneedle arrays may be, without limitation, solid, RNA-coated, dissolving, biodegradable, and/or hollow. In some embodiments, the delivery is effected via a microneedle system, optionally combined with an electronically controlled micropump that delivers the drug at specific times or upon demand. For example, the MACROFLUX (Alza) system may be used.

Other embodiments are directed to a method for delivering a nucleic acid to a cell in vivo comprising applying a nucleic acid to a tissue containing a cell in vivo. In one embodiment, the method further comprises applying a transient electric field in the vicinity of the cell. In another embodiment, the method results in the cell in vivo internalizing the nucleic acid. In yet another embodiment, the nucleic acid comprises synthetic RNA. In a further embodiment, the method further results in the cell internalizing a therapeutically or cosmetically effective amount of the nucleic acid. In one embodiment, the cell is a skin cell. In another embodiment, the cell is a muscle cell. In yet another embodiment, the cell is a dermal fibroblast. In a further embodiment, the cell is a keratinocyte. In a still further embodiment, the cell is a myoblast. In some embodiments, the nucleic acid comprises a protein of interest. In one embodiment, the protein of interest is a fluorescent protein. In another embodiment, the protein of interest is an extra-cellular-matrix protein. In yet another embodiment, the protein of interest is a member of the group: elastin, collagen, laminin, fibronectin, vitronectin, lysyl oxidase, elastin binding protein, a growth factor, fibroblast growth factor, transforming growth factor beta, granulocyte colony-stimulating factor, a matrix metalloproteinase, an actin, fibrillin, microfibril-associated glycoprotein, a lysyl-oxidase-like protein, platelet-derived growth factor, a lipase, an uncoupling protein, thermogenin, filaggrin, a fibroblast growth factor, an antibody, and a protein involved with pigment production. In some embodiments, the method further comprises delivering the nucleic acid to the epidermis. In other embodiments, the method further comprises delivering the nucleic acid to the dermis. In still other embodiments, the method further comprises delivering the nucleic acid below the dermis. In one embodiment, the delivering is by injection. In another embodiment, the delivering is by injection using a micro-needle array. In yet another embodiment, the delivering is by topical administration. In a further embodiment, the delivering comprises disruption or removal of a part of the tissue. In a still further embodiment, the delivering comprises disruption or removal of the stratum corneum. In some embodiments, the nucleic acid is present in solution. In one embodiment, the solution comprises a growth factor. In another embodiment, the growth factor is a member of the group: a fibroblast growth factor and a transforming growth factor. In yet another embodiment, the growth factor is a member of the group: basis fibroblast growth factor and transforming growth factor beta. In other embodiments, the solution comprises cholesterol.

In another embodiment, the method further comprises contacting the cell with one or more nucleic acid molecules. In yet another embodiment, at least one of the one or more nucleic acid molecules encodes a protein of interest. In a further embodiment, the method results in the cell expressing the protein of interest. In a still further embodiment, the method results in the cell expressing a therapeutically or cosmetically effective amount of the protein of interest.

In another embodiment, the cell is contacted with a nucleic acid molecule. In yet another embodiment, the method results in the cell internalizing the nucleic acid molecule. In a further embodiment, the method results in the cell internalizing a therapeutically or cosmetically effective amount of the nucleic acid molecule. In one embodiment, the nucleic acid encodes a protein of interest. In one embodiment, the nucleic acid molecule comprises a member of the group: a dsDNA molecule, a ssDNA molecule, a RNA molecule, a dsRNA molecule, a ssRNA molecule, a plasmid, an oligonucleotide, a synthetic RNA molecule, a miRNA molecule, an mRNA molecule, and an siRNA molecule. In various embodiments, the RNA comprises one or more non-canonical nucleotides.

In some embodiments, the present invention relates to one or more administration techniques described in U.S. Pat. Nos. 5,711,964; 5,891,468; 6,316,260; 6,413,544; 6,770,291; and 7,390,780, the entire contents of which are hereby incorporated by reference in their entireties.

The invention also provides kits that can simplify the administration of the nucleic acid drugs described herein and/or any additional agent described herein. An illustrative kit of the invention comprises a nucleic acid drug and/or any additional agent described herein in unit dosage form. In one embodiment, the unit dosage form is a container, such as a pre-filled syringe, which can be sterile, containing any agent described herein and a pharmaceutically acceptable carrier, diluent, excipient, or vehicle. The kit can further comprise a label or printed instructions instructing the use of any agent described herein. The kit or one or more components of the kit may be stored at room temperature, about 4° C., about −20° C., about −80° C., or about −196° C. The kit may also include a lid speculum, topical anesthetic, and a cleaning agent for the administration location. The kit can also further comprise one or more additional agent described herein. In one embodiment, the kit comprises a container containing an effective amount of a nucleic acid drug as disclosed herein and an effective amount of another composition, such as an additional agent as described herein. In some embodiments, the unit dosage form is a pre-loaded (a.k.a. pre-dosed or pre-filled) syringe or a pen needle injector (injection pen)). Such unit dosage forms may comprise the effective doses of nucleic acid drug described herein, e.g. about 10 ng to about 2000 ng, e.g. about 10 ng, or about 20 ng, or about 50 ng, or about 100 ng, or about 200 ng, or about 300 ng, or about 400 ng, or about 500 ng, or about 600 ng, or about 700 ng, or about 800 ng, or about 900 ng, or about 1000 ng, or about 1100 ng, or about 1200 ng, or about 1300 ng, or about 1400 ng, or about 1500 ng, or about 1600 ng, or about 1700 ng, or about 1800 ng, or about 1900 ng, or about 2000 ng.

Some embodiments are directed to synthetic RNA molecules with low toxicity and high translation efficiency. Other embodiments are directed to a cell-culture medium for high-efficiency in vivo transfection, reprogramming, and gene editing of cells. Other embodiments pertain to methods for producing synthetic RNA molecules encoding reprogramming proteins. Still further embodiments pertain to methods for producing synthetic RNA molecules encoding gene-editing proteins.

Some embodiments are directed to methods of gene-editing and/or gene correction. Some embodiments encompass synthetic RNA-based gene-editing and/or gene correction, e.g. with RNA comprising non-canonical nucleotides, e.g. RNA encoding one or more of a nuclease, a transcription activator-like effector nuclease (TALEN), a zinc-finger nuclease, a meganuclease, a nickase, a clustered regularly interspaced short palindromic repeat (CRISPR)-associated protein or a natural or engineered variant, family-member, orthologue, fragment or fusion construct thereof. In some embodiments, the efficiency of the gene-editing and/or gene correction is high, for example, higher than DNA-based gene editing and/or gene correction. In some embodiments, the present methods of gene-editing and/or gene correction are efficient enough for in vivo application. In some embodiments, the present methods of gene-editing and/or gene correction are efficient enough to not require cellular selection (e.g. selection of cells that have been edited). In various embodiments, the efficiency of gene-editing of the present methods is about 1%, or about 2%, or about 3%, or about 4%, or about 5%, or about 6%, or about 7%, or about 8%, or about 9%, or about 10%, or about 20%, or about 30%, or about 40%, or about 50%, or about 60%, or about 70%, or about 80%, or about 90%, or about 100%. In various embodiments, the efficiency of gene-correction of the present methods is about 1%, or about 2%, or about 3%, or about 4%, or about 5%, or about 6%, or about 7%, or about 8%, or about 9%, or about 10%, or about 20%, or about 30%, or about 40%, or about 50%, or about 60%, or about 70%, or about 80%, or about 90%, or about 100%

Some embodiments are directed to high-efficiency gene-editing proteins comprising engineered nuclease cleavage domains. Other embodiments are directed to high-fidelity gene-editing proteins comprising engineered nuclease cleavage domains. Various embodiments are directed to high-efficiency gene-editing proteins comprising engineered DNA-binding domains. Other embodiments are directed to high-fidelity gene-editing proteins comprising engineered DNA-binding domains. Still other embodiments are directed to gene-editing proteins comprising engineered repeat sequences. Some embodiments are directed to gene-editing proteins comprising one or more CRISPR associated family members. Some embodiments are directed to methods for altering the DNA sequence of a cell by transfecting the cell with or inducing the cell to express a gene-editing protein. Other embodiments are directed to methods for altering the DNA sequence of a cell that is present in an in vitro culture. Still further embodiments are directed to methods for altering the DNA sequence of a cell that is present in vivo.

Some embodiments are directed to methods of modulating the secretion or subcellular localization of a polypeptide. In such embodiments, the present invention provides an RNA encoding a protein comprising a signal peptide operably linked to a polypeptide having biological functionality. In an embodiment, the signal peptide modulates the secretion of the polypeptide. In another embodiment, the signal peptide modulates the subcellular localization of the polypeptide. For example, BMP7 comprising at least one FGF21 signal peptide may result in increased secretion of BMP7. In another example, BMP7 comprising at least one FGF21 signal peptide in place of the endogenous BMP7 signal peptide may result in increased secretion of BMP7. In various embodiments, any of the proteins listed in Table 2A or Table 2B comprising at least one signal peptide listed in the table below may result in increased secretion of the proteins.

| Protein | Signal Peptide |
|---|---|
| Gaussia luciferase | MGVKVLFALICIAVAEA |
| Human BMP7 | MHVRSLRAAAPHSFVALWAPLFLLRSALA |
| Human chymotrypsinogen B | MAFLWLLSCWALLGTTFG |
| Human chymotrypsinogen C | MLGITVLAALLACASS |
| Human EPO | MGVHECPAWLWLLLSLLSLPLGLPVLG |
| Human FGF19 | MRSGCVVVHVWILAGLWLAVAGRP |
| Human FGF21 | MDSDETGFEHSGLWVSVLAGLLLGACQA |
| Human FGF23 | MLGARLRLWVCALCSVCSMSVLRA |
| Human IL2 | MYRMQLLSCIALSLALVTNS |
| Human IL22 | MAALQKSVSSFLMGTLATSCLLLLALLVQGGAA |
| Human IL6 | MNSFSTSAFGPVAFSLGLLLVLPAAFPAP |
| Human Interferon Alpha-2 | MALTFALLVALLVLSCKSSCSVG |
| Human Interferon Beta | MTNKCLLQIALLLCFSTTALS |
| Human Interferon Gamma | MKYTSYILAFQLCIVLGSLGCYC |
| Human Trypsin-1 | MNPLLILTFVAAALA |

Some embodiments are directed to methods of modulating the serum half-life, secretion, bioavailability, and/or activity of a protein comprising administering a RNA encoding the protein and a RNA encoding a receptor for the protein. For example, IL15 may be administered with its receptor, e.g., IL15RA to enhance one or more of the serum half-life, secretion, bioavailability, and activity of IL15.

Many proteins and peptides, when translated from in vitro transcribed RNA, can exhibit reduced activity resulting from incomplete or inadequate post-translational processing. It has now been discovered that the amount of active protein, polypeptide or peptide produced following RNA transfection can be increased by contacting cells with and/or inducing cells to express a second protein that is capable of processing a polypeptide into the protein, peptide or polypeptide. Certain embodiments are therefore directed to a method for inducing a cell to express an active protein, polypeptide or peptide comprising contacting the cell with a synthetic RNA molecule encoding a first polypeptide and contacting the cell with a second protein that is capable of processing the first polypeptide into an active protein, polypeptide or peptide.

In certain embodiments, the second protein is administered to a patient. In one embodiment, the second protein is a recombinant protein. In another embodiment, the cells are contacted with a synthetic RNA molecule encoding the second protein. In a further embodiment, the cells are contacted with and/or induced to express an inhibitor of a molecule that inhibits the second protein. In one embodiment, the inhibitor is a short interfering RNA molecule.

In certain embodiments, the second protein is a member of the PCSK family. In other embodiments, the second protein is a proprotein convertase. In still other embodiments, the second protein is a prohormone convertase. In still other embodiments, the second protein is a carboxypeptidase. In one embodiment, the second protein is PCSK3 (Furin/PACE). In another embodiment, the second protein is primarily secreted. In yet another embodiment, the second protein is primarily intracellular. In a further embodiment, the first polypeptide, protein, polypeptide or peptide is selected from the group: a product of proopiomelanocortin, renin, a product of enkephalin, a product of prodynorphin, somatostatin, insulin, agouti-related peptide, glucagon, parathyroid hormone, a member of the transforming growth factor beta superfamily, albumin, beta-secretase 1, nerve growth factor, caldesmon, the alpha-integrins, factor IX, α-melanocyte-stimulating hormone, adrenocorticotropic hormone, β-endorphin, and met-enkephalin.

Glycation and glycosylation are processes by which one or more sugar molecules are bound to a protein. It has now been discovered that altering the number or location of glycation and glycosylation sites can increase or decrease the stability of a protein. Certain embodiments are therefore directed to a protein with one or more glycation or glycosylation sites. In one embodiment, the protein is engineered to have more glycation or glycosylation sites than a natural variant of the protein. In another embodiment, the protein is engineered to have fewer glycation or glycosylation sites than a natural variant of the protein. In yet another embodiment, the protein has increased stability. In yet another embodiment, the protein has decreased stability. In some embodiments, the protein is a circulating protein. In one embodiment, the protein is erythropoietin or a biologically active fragment, variant, analogue, or family-member thereof. In another embodiment, the protein is darbepoetin alfa or a biologically active fragment, variant, analogue, or family-member thereof. In another embodiment, the protein is NOVEPOETIN or a biologically active fragment, variant, analogue, or family-member thereof.

It has been further discovered that in certain situations, including one or more steroids and/or one or more antioxidants in the transfection medium can increase in vivo transfection efficiency, in vivo reprogramming efficiency, and in vivo gene-editing efficiency. Certain embodiments are therefore directed to contacting a cell or patient with a glucocorticoid, such as hydrocortisone, prednisone, prednisolone, methylprednisolone, dexamethasone or betamethasone. Other embodiments are directed to a method for inducing a cell to express a protein of interest by contacting a cell with a medium containing a steroid and contacting the cell with one or more nucleic acid molecules. In one embodiment, the nucleic acid molecule comprises synthetic RNA. In another embodiment, the steroid is hydrocortisone. In yet another embodiment, the hydrocortisone is present in the medium at a concentration of between about 0.1 uM and about 10 uM, or about 1 uM. Other embodiments are directed to a method for inducing a cell in vivo to express a protein of interest by contacting the cell with a medium containing an antioxidant and contacting the cell with one or more nucleic acid molecules. In one embodiment, the antioxidant is ascorbic acid or ascorbic-acid-2-phosphate. In another embodiment, the ascorbic acid or ascorbic-acid-2-phosphate is present in the medium at a concentration of between about 0.5 mg/L and about 500 mg/L, including about 50 mg/L. Still other embodiments are directed to a method for reprogramming and/or gene-editing a cell in vivo by contacting the cell with a medium containing a steroid and/or an antioxidant and contacting the cell with one or more nucleic acid molecules, wherein the one or more nucleic acid molecules encodes one or more reprogramming and/or gene-editing proteins. In certain embodiments, the cell is present in an organism, and the steroid and/or antioxidant are delivered to the organism.

Adding transferrin to the complexation medium has been reported to increase the efficiency of plasmid transfection in certain situations. It has now been discovered that adding transferrin to the complexation medium can also increase the efficiency of in vivo transfection with synthetic RNA molecules. Certain embodiments are therefore directed to a method for inducing a cell in vivo to express a protein of interest by adding one or more synthetic RNA molecules and a transfection reagent to a solution containing transferrin. In one embodiment, the transferrin is present in the solution at a concentration of between about 1 mg/L and about 100 mg/L, such as about 5 mg/L. In another embodiment, the transferrin is recombinant.

In certain situations, including pertaining to culturing, it may be desirable to replace animal-derived components with non-animal-derived and/or recombinant components, in part because non-animal-derived and/or recombinant components can be produced with a higher degree of consistency than animal-derived components, and in part because non-animal-derived and/or recombinant components carry less risk of contamination with toxic and/or pathogenic substances than do animal-derived components. Certain embodiments are therefore directed to a protein that is non-animal-derived and/or recombinant. Other embodiments are directed to a medium, wherein some or all of the components of the medium are non-animal-derived and/or recombinant.

Other embodiments are directed to a method for transfecting a cell in vivo. In one embodiment, a cell in vivo is transfected with one or more nucleic acids, and the transfection is performed using a transfection reagent, such as a lipid-based transfection reagent. In one embodiment, the one or more nucleic acids includes at least one RNA molecule. In another embodiment, the cell is transfected with one or more nucleic acids, and the one or more nucleic acids encodes at least one of: p53, TERT, an antibody, an extracellular matrix protein, a cytokine, a secreted protein, a membrane-bound protein, an enzyme, a gene-editing protein, a chromatin-modifying protein, a DNA-binding protein, a transcription factor, a histone deacetylase, a pathogen-associated molecular pattern, and a tumor-associated antigen or a biologically active fragment, analogue, variant or family-member thereof. In another embodiment, the cell is transfected repeatedly, such as at least about 2 times during about 10 consecutive days, or at least about 3 times during about 7 consecutive days, or at least about 4 times during about 6 consecutive days. Some embodiments are directed to a method for increasing expression of telomerase in one of a fibroblast, a hematopoietic stem cell, a mesenchymal stem cells, a cardiac stem cell, a hair follicle stem cell, a neural stem cell, an intestinal stem cell, an endothelial stem cell, an olfactory stem cell, a neural crest stem cell, a testicular cell, and a keratinocyte. Some embodiments are directed to a method for increasing the length of telomeres in one of a fibroblast, a hematopoietic stem cell, a mesenchymal stem cells, a cardiac stem cell, a hair follicle stem cell, a neural stem cell, an intestinal stem cell, an endothelial stem cell, an olfactory stem cell, a neural crest stem cell, a testicular cell, and a keratinocyte. Other embodiments are directed to a method for isolating a cell from a patient, contacting the cell with a nucleic acid drug encoding a component of telomerase (e.g., TERT), and reintroducing the cell to the patient. Various embodiments are directed to a method for increasing the replicative potential of a cell.

Reprogramming can be performed by transfecting cells with one or more nucleic acids encoding one or more reprogramming factors. Examples of reprogramming factors include, but are not limited to: Oct4 protein, Sox2 protein, Klf4 protein, c-Myc protein, I-Myc protein, TERT protein, Nanog protein, Lin28 protein, Utf1 protein, Aicda protein, miR200 micro-RNA, miR302 micro-RNA, miR367 micro-RNA, miR369 micro-RNA and biologically active fragments, analogues, variants and family-members thereof. Certain embodiments are therefore directed to a method for reprogramming a cell in vivo. In one embodiment, the cell in vivo is reprogrammed by transfecting the cell with one or more nucleic acids encoding one or more reprogramming factors. In one embodiment, the one or more nucleic acids includes an RNA molecule that encodes Oct4 protein. In another embodiment, the one or more nucleic acids also includes one or more RNA molecules that encodes Sox2 protein, Klf4 protein, and c-Myc protein. In yet another embodiment, the one or more nucleic acids also includes an RNA molecule that encodes Lin28 protein. In one embodiment, the cell is a human skin cell, and the human skin cell is reprogrammed to a pluripotent stem cell. In another embodiment, the cell is a human skin cell, and the human skin cell is reprogrammed to a glucose-responsive insulin-producing cell. Examples of other cells that can be reprogrammed and other cells to which a cell can be reprogrammed include, but are not limited to: skin cells, pluripotent stem cells, mesenchymal stem cells, β-cells, retinal pigmented epithelial cells, hematopoietic cells, cardiac cells, airway epithelial cells, neural stem cells, neurons, glial cells, bone cells, blood cells, and dental pulp stem cells. In one embodiment, the cell is contacted with a medium that supports the reprogrammed cell. In one embodiment, the medium also supports the cell.

Importantly, infecting skin cells with viruses encoding Oct4, Sox2, Klf4, and c-Myc, combined with culturing the cells in a medium that supports the growth of cardiomyocytes, has been reported to cause reprogramming of the skin cells to cardiomyocytes, without first reprogramming the skin cells to pluripotent stem cells (See Efs et al Nat Cell Biol. 2011; 13:215-22, the contents of which are hereby incorporated by reference). In certain situations, direct reprogramming (reprogramming one somatic cell to another somatic cell without first reprogramming the somatic cell to a pluripotent stem cell, also known as "transdifferentiation") may be desirable, in part because culturing pluripotent stem cells can be time-consuming and expensive, the additional handling involved in establishing and characterizing a stable pluripotent stem cell line can carry an increased risk of contamination, and the additional time in culture associated with first producing pluripotent stem cells can carry an increased risk of genomic instability and the acquisition of mutations, including point mutations, copy-number variations, and karyotypic abnormalities. Certain embodiments are therefore directed to a method for reprogramming a somatic cell in vivo, wherein the cell is reprogrammed to a somatic cell, and wherein a characterized pluripotent stem-cell line is not produced.

It has been further discovered that, in certain situations, fewer total transfections may be required to reprogram a cell according to the methods of the present invention than according to other methods. Certain embodiments are therefore directed to a method for reprogramming a cell in vivo, wherein between about 1 and about 12 transfections are performed during about 20 consecutive days, or between about 4 and about 10 transfections are performed during about 15 consecutive days, or between about 4 and about 8 transfections are performed during about 10 consecutive days. It is recognized that when a cell is contacted with a medium containing nucleic acid molecules, the cell may likely come into contact with and/or internalize more than one nucleic acid molecule either simultaneously or at different times. A cell can therefore be contacted with a nucleic acid more than once, e.g. repeatedly, even when a cell is contacted only once with a medium containing nucleic acids.

Of note, nucleic acids can contain one or more non-canonical or "modified" residues as described herein. For instance, any of the non-canonical nucleotides described herein can be used in the present reprogramming methods. In one embodiment, pseudouridine-5'-triphosphate can be substituted for uridine-5'-triphosphate in an in vitro-transcription reaction to yield synthetic RNA, wherein up to 100% of the uridine residues of the synthetic RNA may be replaced with pseudouridine residues. In vitro-transcription can yield RNA with residual immunogenicity, even when pseudouridine and 5-methylcytidine are completely substituted for uridine and cytidine, respectively (see, e.g., Angel. Reprogramming Human Somatic Cells to Pluripotency Using RNA [Doctoral Thesis]. Cambridge, Mass.: MIT; 2011, the contents of which are hereby incorporated by reference). For this reason, it is common to add an immunosuppressant to the transfection medium when transfecting cells with RNA. In certain situations, adding an immunosuppressant to the transfection medium may not be desirable, in part because the recombinant immunosuppressant most commonly used for this purpose, B18R, can be expensive and difficult to manufacture. It has now been discovered that cells in vivo can be transfected and/or reprogrammed according to the methods of the present invention, without using B18R or any other immunosuppressant. It has been further discovered that reprogramming cells in vivo according to the methods of the present invention without using immunosuppressants can be rapid, efficient, and reliable. Certain embodiments are therefore directed to a method for transfecting a cell in vivo, wherein the transfection medium does not contain an immunosuppressant. Other embodiments are directed to a method for reprogramming a cell in vivo, wherein the transfection medium does not contain an immunosuppressant. In certain situations, for example when using a high cell density, it may be beneficial to add an immunosuppressant to the transfection medium. Certain embodiments are therefore directed to a method for transfecting a cell in vivo, wherein the transfection medium contains an immunosuppressant. Other embodiments are directed to a method for reprogramming a cell in vivo, wherein the transfection medium contains an immunosuppressant. In one embodiment, the immunosuppressant is B18R or a biologically active fragment, analogue, variant or family-member thereof or dexamethasone or a derivative thereof. In one embodiment, the transfection medium does not contain an immunosuppressant, and the nucleic-acid dose is chosen to prevent excessive toxicity. In another embodiment, the nucleic-acid dose is less than about 1 mg/cm$^2$ of tissue or less than about 1 mg/100,000 cells or less than about 10 mg/kg.

Reprogrammed cells produced according to certain embodiments of the present invention are suitable for therapeutic and/or cosmetic applications as they do not contain undesirable exogenous DNA sequences, and they are not exposed to animal-derived or human-derived products, which may be undefined, and which may contain toxic and/or pathogenic contaminants. Furthermore, the high speed, efficiency, and reliability of certain embodiments of the present invention may reduce the risk of acquisition and accumulation of mutations and other chromosomal abnormalities. Certain embodiments of the present invention can thus be used to generate cells that have a safety profile adequate for use in therapeutic and/or cosmetic applications. For example, reprogramming cells using RNA and the medium of the present invention, wherein the medium does not contain animal or human-derived components, can yield cells that have not been exposed to allogeneic material. Certain embodiments are therefore directed to a reprogrammed cell that has a desirable safety profile. In one embodiment, the reprogrammed cell has a normal karyotype. In another embodiment, the reprogrammed cell has fewer than about 5 copy-number variations (CNVs) relative to the patient genome, such as fewer than about 3 copy-number variations relative to the patient genome, or no copy-number variations relative to the patient genome. In yet another embodiment, the reprogrammed cell has a normal karyotype and fewer than about 100 single nucleotide variants in coding regions relative to the patient genome, or fewer than about 50 single nucleotide variants in coding regions relative to the patient genome, or fewer than about 10 single nucleotide variants in coding regions relative to the patient genome.

Endotoxins and nucleases can co-purify and/or become associated with other proteins, such as serum albumin. Recombinant proteins, in particular, can often have high levels of associated endotoxins and nucleases, due in part to the lysis of cells that can take place during their production. Endotoxins and nucleases can be reduced, removed, replaced or otherwise inactivated by many of the methods of the present invention, including, for example, by acetylation, by addition of a stabilizer such as sodium octanoate, followed by heat treatment, by the addition of nuclease inhibitors to the albumin solution and/or medium, by crystallization, by contacting with one or more ion-exchange resins, by contacting with charcoal, by preparative electrophoresis or by affinity chromatography. It has now been discovered that partially or completely reducing, removing, replacing or otherwise inactivating endotoxins and/or nucleases from a medium and/or from one or more components of a medium can increase the efficiency with which cells can be transfected and reprogrammed. Certain embodiments are therefore directed to a method for transfecting a cell in vivo with one or more nucleic acids, wherein the transfection medium is treated to partially or completely reduce, remove, replace or otherwise inactivate one or more endotoxins and/or nucleases. Other embodiments are directed to a medium that causes minimal degradation of nucleic acids. In one embodiment, the medium contains less than about 1 EU/mL, or less than about 0.1 EU/mL, or less than about 0.01 EU/mL.

In certain situations, protein-based lipid carriers such as serum albumin can be replaced with non-protein-based lipid carriers such as methyl-beta-cyclodextrin. The medium of the present invention can also be used without a lipid carrier, for example, when transfection is performed using a method that may not require or may not benefit from the presence of a lipid carrier, for example, using one or more lipid-based transfection reagents, polymer-based transfection reagents or peptide-based transfection reagents or using electroporation. Many protein-associated molecules, such as metals, can be highly toxic to cells in vivo. This toxicity can cause decreased viability, as well as the acquisition of mutations. Certain embodiments thus have the additional benefit of producing cells that are free from toxic molecules.

The associated-molecule component of a protein can be measured by suspending the protein in solution and measuring the conductivity of the solution. Certain embodiments are therefore directed to a medium that contains a protein, wherein about a 10% solution of the protein in water has a conductivity of less than about 500 μmho/cm. In one embodiment, the solution has a conductivity of less than about 50 μmho/cm. In another embodiment, less than about 0.65% of the dry weight of the protein comprises lipids and/or less than about 0.35% of the dry weight of the protein comprises free fatty acids.

The amount of nucleic acid delivered to cells in vivo can be increased to increase the desired effect of the nucleic acid. However, increasing the amount of nucleic acid delivered to cells in vivo beyond a certain point can cause a decrease in the viability of the cells, due in part to toxicity of the transfection reagent. It has now been discovered that when a nucleic acid is delivered to a population of cells in vivo in a fixed volume (for example, cells in a region of tissue), the amount of nucleic acid delivered to each cell can depend on the total amount of nucleic acid delivered to the population of cells and to the density of the cells, with a higher cell density resulting in less nucleic acid being delivered to each cell. In certain embodiments, a cell in vivo is transfected with one or more nucleic acids more than once. Under certain conditions, for example when the cells are proliferating, the cell density may change from one transfection to the next. Certain embodiments are therefore directed to a method for transfecting a cell in vivo with a nucleic acid, wherein the cell is transfected more than once, and wherein the amount of nucleic acid delivered to the cell is different for two of the transfections. In one embodiment, the cell proliferates between two of the transfections, and the amount of nucleic acid delivered to the cell is greater for the second of the two transfections than for the first of the two transfections. In another embodiment, the cell is transfected more than twice, and the amount of nucleic acid delivered to the cell is greater for the second of three transfections than for the first of the same three transfections, and the amount of nucleic acid delivered to the cells is greater for the third of the same three transfections than for the second of the same three transfections. In yet another embodiment, the cell is transfected more than once, and the maximum amount of nucleic acid delivered to the cell during each transfection is sufficiently low to yield at least about 80% viability for at least two consecutive transfections.

It has now been discovered that modulating the amount of nucleic acid delivered to a population of proliferating cells in vivo in a series of transfections can result in both an increased effect of the nucleic acid and increased viability of the cells. It has been further discovered that, in certain situations, when cells in vivo are contacted with one or more nucleic acids encoding one or more reprogramming factors in a series of transfections, the efficiency of reprogramming can be increased when the amount of nucleic acid delivered in later transfections is greater than the amount of nucleic acid delivered in earlier transfections, for at least part of the series of transfections. Certain embodiments are therefore directed to a method for reprogramming a cell in vivo, wherein one or more nucleic acids is repeatedly delivered to the cell in a series of transfections, and the amount of the nucleic acid delivered to the cell is greater for at least one later transfection than for at least one earlier transfection. In one embodiment, the cell is transfected between about 2 and about 10 times, or between about 3 and about 8 times, or between about 4 and about 6 times. In another embodiment, the one or more nucleic acids includes at least one RNA molecule, the cell is transfected between about 2 and about 10 times, and the amount of nucleic acid delivered to the cell in each transfection is the same as or greater than the amount of nucleic acid delivered to the cell in the most recent previous transfection. In yet another embodiment, the amount of nucleic acid delivered to the cell in the first transfection is between about 20 ng/cm$^2$ and about 250 ng/cm$^2$, or between 100 ng/cm$^2$ and 600 ng/cm$^2$. In yet another embodiment, the cell is transfected about 5 times at intervals of between about 12 and about 48 hours, and the amount of nucleic acid delivered to the cell is about 25 ng/cm$^2$ for the first transfection, about 50 ng/cm$^2$ for the second transfection, about 100 ng/cm$^2$ for the third transfection, about 200 ng/cm$^2$ for the fourth transfection, and about 400 ng/cm$^2$ for the fifth transfection. In yet another embodiment, the cell is further transfected at least once after the fifth transfection, and the amount of nucleic acid delivered to the cell is about 400 ng/cm$^2$.

Certain embodiments are directed to a method for transfecting a cell in vivo with a nucleic acid, wherein the amount of nucleic acid is determined by measuring the cell density, and choosing the amount of nucleic acid to transfect based on the measurement of cell density. In one embodiment, the cell density is measured by optical means. In another embodiment, the cell is transfected repeatedly, the cell density increases between two transfections, and the amount of nucleic acid transfected is greater for the second of the two transfections than for the first of the two transfections.

It has now been discovered that, in certain situations, the amount of a circulating protein that is produced in a patient can be increased by administering to a patient a nucleic acid at a plurality of administration sites. In certain embodiments, the amount of a circulating protein is increased relative to the amount of the circulating protein that is produced in a patient by administering to the patient the nucleic acid at a single injection site. In one embodiment, the administering is by injection. In another embodiment, the injection is intradermal injection. In still another embodiment, the injection is subcutaneous or intramuscular injection. In some embodiments, the plurality of administration sites comprise administration sites in the skin. In other embodiments, the plurality of administration sites are at least about 1 or at least about 2 or at least about 5 or at least about 10 or at least about 20 or at least about 50 or at least about 100 administration sites. In one embodiment, the administering is performed within at least about 5 minutes or at least about 10 minutes or at least about 30 minutes or at least about 1 hour or at least about 2 hours or at least about 5 hours or at least about 12 hours or at least about 1 day. In certain embodiments, the amount of a circulating protein is increased by at least about 10 percent or at least about 20 percent or at least about 50 percent or at least about 100 percent or at least about 3-fold or at least about 5-fold or at least about 10-fold or at least about 20-fold or at least about 50-fold or at least about 100-fold or at least about 500-fold or at least about 1000-fold or greater than 1000-fold.

It has now been discovered that, in certain situations, the in vivo transfection efficiency and viability of cells contacted with the medium of the present invention can be improved by conditioning the medium. Certain embodiments are therefore directed to a method for conditioning a medium. Other embodiments are directed to a medium that is conditioned. In one embodiment, the feeders are fibroblasts, and the medium is conditioned for approximately 24 hours. Other embodiments are directed to a method for transfecting a cell in vivo, wherein the transfection medium is conditioned. Other embodiments are directed to a method for reprogramming and/or gene-editing a cell in vivo, wherein the medium is conditioned. In one embodiment, the feeders are mitotically inactivated, for example, by exposure to a chemical such as mitomycin-C or by exposure to gamma radiation. In certain embodiments, it may be beneficial to use only autologous materials, in part to, for example and not wishing to be bound by theory, avoid the risk of disease transmission from the feeders to the cell or the patient. Certain embodiments are therefore directed to a method for transfecting a cell in vivo, wherein the transfection medium is conditioned, and wherein the feeders are derived from the same individual as the cell being transfected. Other embodiments are directed to a method for reprogramming and/or gene-editing a cell in vivo, wherein the medium is conditioned, and wherein the feeders are derived from the same individual as the cell being reprogrammed and/or gene-edited.

Several molecules can be added to media by conditioning. Certain embodiments are therefore directed to a medium that is supplemented with one or more molecules that are present in a conditioned medium. In one embodiment, the medium is supplemented with Wnt1, Wnt2, Wnt3, Wnt3a or a biologically active fragment, analogue, variant, agonist, or family-member thereof. In another embodiment, the medium is supplemented with TGF-β or a biologically active fragment, analogue, variant, agonist, or family-member thereof. In yet another embodiment, a cell in vivo is reprogrammed according to the method of the present invention, wherein the medium is not supplemented with TGF-β for between about 1 and about 5 days, and is then supplemented with TGF-β for at least about 2 days. In yet another embodiment, the medium is supplemented with IL-6, IL-6R or a biologically active fragment, analogue, variant, agonist, or family-member thereof. In yet another embodiment, the medium is supplemented with a sphingolipid or a fatty acid. In still another embodiment, the sphingolipid is lysophosphatidic acid, lysosphingomyelin, sphingosine-1-phosphate or a biologically active analogue, variant or derivative thereof.

In addition to mitotically inactivating cells, under certain conditions, irradiation can change the gene expression of cells, causing cells to produce less of certain proteins and more of certain other proteins that non-irradiated cells, for example, members of the Wnt family of proteins. In addition, certain members of the Wnt family of proteins can promote the growth and transformation of cells. It has now been discovered that, in certain situations, the efficiency of reprogramming can be greatly increased by contacting a cell in vivo with a medium that is conditioned using irradiated feeders instead of mitomycin-c-treated feeders. It has been further discovered that the increase in reprogramming efficiency observed when using irradiated feeders is caused in part by Wnt proteins that are secreted by the feeders. Certain embodiments are therefore directed to a method for reprogramming a cell in vivo, wherein the cell is contacted with Wnt1, Wnt2, Wnt3, Wnt3a or a biologically active fragment, analogue, variant, family-member or agonist thereof, including agonists of downstream targets of Wnt proteins, and/or agents that mimic one or more of the biological effects of Wnt proteins, for example, 2-amino-4-[3,4-(methylenedioxy)benzylamino]-6-(3-methoxyphenyl)pyrimidine.

Because of the low efficiency of many DNA-based reprogramming methods, these methods may be difficult or impossible to use with cells derived from patient samples, which may contain only a small number of cells. In contrast, the high efficiency of certain embodiments of the present invention can allow reliable reprogramming of a small number of cells, including single cells. Certain embodiments are directed to a method for reprogramming a small number of cells. Other embodiments are directed to a method for reprogramming a single cell. In one embodiment, the cell is contacted with one or more enzymes. In another embodiment, the enzyme is collagenase. In yet another embodiment, the collagenase is animal-component free. In one embodiment, the collagenase is present at a concentration of between about 0.1 mg/mL and about 10 mg/mL, or between about 0.5 mg/mL and about 5 mg/mL. In another embodiment, the cell is a blood cell. In yet another embodiment, the cell is contacted with a medium containing one or more proteins that is derived from the patient's blood. In still another embodiment, the cell is contacted with a medium comprising: DMEM/F12+2 mM L-alanyl-L-glutamine+ between about 5% and about 25% patient-derived serum, or between about 10% and about 20% patient-derived serum, or about 20% patient-derived serum.

It has now been discovered that, in certain situations, transfecting cells in vivo with a mixture of RNA encoding Oct4, Sox2, Klf4, and c-Myc using the medium of the present invention can cause the rate of proliferation of the cells to increase. When the amount of RNA delivered to the cells is too low to ensure that all of the cells are transfected, only a fraction of the cells may show an increased proliferation rate. In certain situations, such as when generating a personalized therapeutic, increasing the proliferation rate of cells may be desirable, in part because doing so can reduce the time necessary to generate the therapeutic, and therefore can reduce the cost of the therapeutic. Certain embodiments are therefore directed to a method for transfecting a cell in vivo with a mixture of RNA encoding Oct4, Sox2, Klf4, and c-Myc. In one embodiment, the cell exhibits an increased proliferation rate. In another embodiment, the cell is reprogrammed.

Many diseases are associated with one or more mutations. Mutations can be corrected by contacting a cell with a nucleic acid that encodes a protein that, either alone or in combination with other molecules, corrects the mutation (an example of gene-editing). Examples of such proteins include: a nuclease, a transcription activator-like effector nuclease (TALEN), a zinc-finger nuclease, a meganuclease, a nickase, a clustered regularly interspaced short palindromic repeat (CRISPR)-associated protein or a natural or engineered variant, family-member, orthologue, fragment or fusion construct thereof. Certain embodiments are therefore directed to a method for transfecting a cell in vivo with a nucleic acid, wherein the nucleic acid encodes a protein that, either alone or in combination with other molecules, creates a single-strand or double-strand break in a DNA molecule. In a one embodiment, the protein is a zinc finger nuclease or a TALEN. In another embodiment, the nucleic acid is an RNA molecule. In yet another embodiment, the single-strand or double-strand break is within about 5,000,000 bases of the transcription start site of a gene selected from the group: CCR5, CXCR4, GAD1, GAD2, CFTR, HBA1, HBA2, HBB, HBD, FANCA, XPA, XPB, XPC, ERCC2, POLH, HTT, DMD, SOD1, APOE, PRNP, BRCA1, and BRCA2 or an analogue, variant or family-member thereof. In one embodiment, the present invention relates to gene-editing of the MYC protein (e.g. correcting one or more mutations that may be linked to cancer), optionally with a TALEN. In yet another embodiment, the cell is transfected with a nucleic acid that acts as a repair template by either causing the insertion of a DNA sequence in the region of the single-strand or double-strand break or by causing the DNA sequence in the region of the single-strand or double-strand break to otherwise change. In yet another embodiment, the cell is reprogrammed, and subsequently, the cell is gene-edited. In yet another embodiment, the cell is gene-edited, and subsequently, the cell is reprogrammed. In yet another embodiment, the gene-editing and reprogramming are performed within about 7 days of each other. In yet another embodiment, the gene-editing and reprogramming occur simultaneously or on the same day. In yet another embodiment, the cell is a skin cell, the skin cell is gene-edited to disrupt the CCR5 gene, the skin cell is reprogrammed to a hematopoietic stem cell, thus producing a therapeutic for HIV/AIDS, and the therapeutic is used to treat a patient with HIV/AIDS. In yet another embodiment, the skin cell is derived from the same patient whom the therapeutic is used to treat.

Genes that can be edited according to the methods of the present invention to produce therapeutics of the present invention include genes that can be edited to restore normal function, as well as genes that can be edited to reduce or eliminate function. Such genes include, but are not limited to beta globin (HBB), mutations in which can cause sickle cell disease (SCD) and β-thalassemia, breast cancer 1, early onset (BRCA1) and breast cancer 2, early onset (BRCA2), mutations in which can increase susceptibility to breast cancer, C—C chemokine receptor type 5 (CCR5) and C—X—C chemokine receptor type 4 (CXCR4), mutations in which can confer resistance to HIV infection, cystic fibrosis transmembrane conductance regulator (CFTR), mutations in which can cause cystic fibrosis, dystrophin (DMD), mutations in which can cause muscular dystrophy, including Duchenne muscular dystrophy and Becker's muscular dystrophy, glutamate decarboxylase 1 and glutamate decarboxylase 2 (GAD1, GAD2), mutations in which can prevent autoimmune destruction of β-cells, hemoglobin alpha 1, hemoglobin alpha 2, and hemoglobin delta (HBA1, HBA2, and HBD), mutations in which can cause thalassemia, desmoplakin, keratin 5, keratin 14, plectin, integrin alpha-6, integrin beta-4, laminin subunit alpha-3, laminin subunit beta-3, laminin subunit gamma-2, collagen type VII alpha 1, collagen type XVII alpha 1, and matrix metalloproteinase-1 (DSP, KRT5, KRT14, PLEC1, ITGA6, ITGB4, LAMA3, LAMB3, LAMC2, COL7A1, COL17A1, and MMP1), mutations in which can cause epidermolysis bullosa, Huntington (HTT), mutations in which can cause Huntington's disease, superoxide dismutase 1 (SOD1), mutations in which can cause amyotrophic lateral sclerosis (ALS), XPA, XPB, XPC, XPD (ERCC6) and polymerase (DNA directed), eta (POLH), mutations in which can cause xeroderma pigmentosum, leucine-rich repeat kinase 2 (LRRK2), mutations in which can cause Parkinson's disease, and Fanconi anemia, complementation groups A, B, C, D1, D2, E, F, G, I, J, L, M, N, P (FANCA, FANCB, FANCC, FANCD1, FANCD2, FANCE, FANCF, FANCG, FANCI, FANCJ, FANCL, FANCM, FANCN, FANCP), and RAD51 homolog C (S. cerevisiae) (RAD51C), mutations in which can cause Fanconi anemia.

Certain embodiments are directed to a therapeutic comprising a nucleic acid. In one embodiment, the nucleic acid encodes one or more gene-editing proteins. Other embodiments are directed to a therapeutic comprising one or more cells that are transfected, reprogrammed, and/or gene-edited in vivo according to the methods of the present invention. In one embodiment, a cell is transfected, reprogrammed, and/or gene-edited, and the transfected, reprogrammed, and/or gene-edited cell is introduced into a patient. In another embodiment, the cell is harvested from the same patient into whom the transfected, reprogrammed and/or gene-edited cell is introduced. Examples of diseases that can be treated with therapeutics of the present invention include, but are not limited to Alzheimer's disease, spinal cord injury, amyotrophic lateral sclerosis, cystic fibrosis, heart disease, including ischemic and dilated cardiomyopathy, macular degeneration, Parkinson's disease, Huntington's disease, diabetes, sickle-cell anemia, thalassemia, Fanconi anemia, xeroderma pigmentosum, muscular dystrophy, severe combined immunodeficiency, hereditary sensory neuropathy, cancer, and HIV/AIDS. In certain embodiments, the therapeutic comprises a cosmetic. In one embodiment, a cell is harvested from a patient, the cell is reprogrammed and expanded to a large number of adipose cells to produce a cosmetic, and the cosmetic is introduced into the patient. In still another embodiment, the cosmetic is used for tissue reconstruction.

While detailed examples are provided herein for the production of specific types of cells and for the production of therapeutics comprising specific types of cells, it is recognized that the methods of the present invention can be used to produce many other types of cells, and to produce therapeutics comprising one or more of many other types of cells, for example, by reprogramming a cell according to the methods of the present invention, and culturing the cell under conditions that mimic one or more aspects of development by providing conditions that resemble the conditions present in the cellular microenvironment during development.

Certain embodiments are directed to a library of cells with a variety of human leukocyte antigen (HLA) types ("HLA-matched libraries"). An HLA-matched library may be beneficial in part because it can provide for the rapid production and/or distribution of therapeutics without the patient having to wait for a therapeutic to be produced from the patient's cells. Such a library may be particularly beneficial for the production of cosmetics and for the treatment of heart disease and diseases of the blood and/or immune system for which patients may benefit from the immediate availability of a therapeutic or cosmetic.

The DNA sequence of a cell can be altered by contacting the cell with a gene-editing protein or by inducing the cell to express a gene-editing protein. However, previously disclosed gene-editing proteins suffer from low binding efficiency and excessive off-target activity, which can introduce undesired mutations in the DNA of the cell, severely limiting their use in vivo, for example in therapeutic and cosmetic applications, in which the introduction of undesired mutations in a patient's cells could lead to the development of cancer. It has now been discovered that gene-editing proteins that comprise the StsI endonuclease cleavage domain (SEQ ID NO: 1) can exhibit substantially lower off-target activity in vivo than previously disclosed gene-editing proteins, while maintaining a high level of on-target activity in vivo. Other novel engineered proteins have also been discovered that can exhibit high on-target activity in vivo, low off-target activity in vivo, small size, solubility, and other desirable characteristics when they are used as the nuclease domain of a gene-editing protein: StsI-HA (SEQ ID NO: 2), StsI-HA2 (SEQ ID NO: 3), StsI-UHA (SEQ ID NO: 4), StsI-UHA2 (SEQ ID NO: 5), StsI-HF (SEQ ID NO: 6), and StsI-UHF (SEQ ID NO: 7). StsI-HA, StsI-HA2 (high activity), StsI-UHA, and StsI-UHA2 (ultra-high activity) can exhibit higher on-target activity in vivo than both wild-type StsI and wild-type FokI, due in part to specific amino-acid substitutions within the N-terminal region at the 34 and 61 positions, while StsI-HF (high fidelity) and StsI-UHF (ultra-high fidelity) can exhibit lower off-target activity in vivo than both wild-type StsI and wild-type FokI, due in part to specific amino-acid substitutions within the C-terminal region at the 141 and 152 positions.

Certain embodiments are therefore directed to a protein. In some embodiments, the protein is present in vivo. In other embodiments, the protein comprises a nuclease domain. In one embodiment, the nuclease domain comprises one or more of: the cleavage domain of FokI endonuclease (SEQ ID NO: 53), the cleavage domain of StsI endonuclease (SEQ ID NO: 1), StsI-HA (SEQ ID NO: 2), StsI-HA2 (SEQ ID NO: 3), StsI-UHA (SEQ ID NO: 4), StsI-UHA2 (SEQ ID NO: 5), StsI-HF (SEQ ID NO: 6), and StsI-UHF (SEQ ID NO: 7) or a biologically active fragment or variant thereof.

It has also been discovered that engineered gene-editing proteins that comprise DNA-binding domains comprising certain novel repeat sequences can exhibit lower off-target activity in vivo than previously disclosed gene-editing proteins, while maintaining a high level of on-target activity in vivo. Certain of these engineered gene-editing proteins can provide several advantages over previously disclosed gene-editing proteins, including, for example, increased flexibility of the linker region connecting repeat sequences, which can result in increased binding efficiency. Certain embodiments are therefore directed to a protein comprising a plurality of repeat sequences. In one embodiment, at least one of the repeat sequences contains the amino-acid sequence: GabG, where "a" and "b" each represent any amino acid. In one embodiment, the protein is a gene-editing protein. In another embodiment, one or more of the repeat sequences are present in a DNA-binding domain. In a further embodiment, "a" and "b" are each independently selected from the group: H and G. In a still further embodiment, "a" and "b" are H and G, respectively. In one embodiment, the amino-acid sequence is present within about 5 amino acids of the C-terminus of the repeat sequence. In another embodiment, the amino-acid sequence is present at the C-terminus of the repeat sequence. In some embodiments, one or more G in the amino-acid sequence GabG is replaced with one or more amino acids other than G, for example A, H or GG. In one embodiment, the repeat sequence has a length of between about 32 and about 40 amino acids or between about 33 and about 39 amino acids or between about 34 and 38 amino acids or between about 35 and about 37 amino acids or about 36 amino acids or greater than about 32 amino acids or greater than about 33 amino acids or greater than about 34 amino acids or greater than about 35 amino acids. Other embodiments are directed to a protein comprising one or more transcription activator-like effector domains. In one embodiment, at least one of the transcription activator-like effector domains comprises a repeat sequence. Other embodiments are directed to a protein comprising a plurality of repeat sequences generated by inserting one or more amino acids between at least two of the repeat sequences of a transcription activator-like effector domain. In one embodiment, one or more amino acids is inserted about 1 or about 2 or about 3 or about 4 or about 5 amino acids from the C-terminus of at least one repeat sequence. Still other embodiments are directed to a protein comprising a plurality of repeat sequences, wherein about every other repeat sequence has a different length than the repeat sequence immediately preceding or following the repeat sequence. In one embodiment, every other repeat sequence is about 36 amino acids long. In another embodiment, every other repeat sequence is 36 amino acids long. Still other embodiments are directed to a protein comprising a plurality of repeat sequences, wherein the plurality of repeat sequences comprises at least two repeat sequences that are each at least 36 amino acids long, and wherein at least two of the repeat sequences that are at least 36 amino acids long are separated by at least one repeat sequence that is less than 36 amino acids long. Some embodiments are directed to a protein that comprises one or more sequences selected from, for example, SEQ ID NO: 54, SEQ ID NO: 55, SEQ ID NO: 56, SEQ ID NO: 57, SEQ ID NO: 58, SEQ ID NO: 59, and SEQ ID NO: 60.

Other embodiments are directed to a protein that comprises a DNA-binding domain. In some embodiments, the DNA-binding domain comprises a plurality of repeat sequences. In one embodiment, the plurality of repeat sequences enables high-specificity recognition of a binding site in a target DNA molecule. In another embodiment, at least two of the repeat sequences have at least about 50%, or about 60%, or about 70%, or about 80%, or about 90%, or about 95%, or about 98%, or about 99% homology to each other. In a further embodiment, at least one of the repeat sequences comprises one or more regions capable of binding to a binding site in a target DNA molecule. In a still further embodiment, the binding site comprises a defined sequence of between about 1 to about 5 bases in length. In one embodiment, the DNA-binding domain comprises a zinc finger. In another embodiment, the DNA-binding domain comprises a transcription activator-like effector (TALE). In a further embodiment, the plurality of repeat sequences includes at least one repeat sequence having at least about 50% or about 60% or about 70% or about 80% or about 90% or about 95% or about 98%, or about 99% homology to a TALE. In a still further embodiment, the gene-editing protein comprises a clustered regularly interspaced short palindromic repeat (CRISPR)-associated protein. In one embodiment, the gene-editing protein comprises a nuclear-localization sequence. In another embodiment, the nuclear-localization sequence comprises the amino-acid sequence: PKKKRKV (SEQ ID NO:471). In one embodiment, the gene-editing protein comprises a mitochondrial-localization sequence. In another embodiment, the mitochondrial-localization sequence comprises the amino-acid sequence: LGRVIPRKIASRASLM (SEQ ID NO:472). In one embodiment, the gene-editing protein comprises a linker. In another embodiment, the linker connects a DNA-binding domain to a nuclease domain. In a further embodiment, the linker is between about 1 and about 10 amino acids long. In some embodiments, the linker is about 1, about 2, or about 3, or about 4, or about 5, or about 6, or about 7, or about 8, or about 9, or about 10 amino acids long. In one embodiment, the gene-editing protein is capable of generating a nick or a double-strand break in a target DNA molecule.

Certain embodiments are directed to a method for modifying the genome of a cell in vivo, the method comprising introducing into a cell in vivo a nucleic acid molecule encoding a non-naturally occurring fusion protein comprising an artificial transcription activator-like (TAL) effector repeat domain comprising one or more repeat units 36 amino acids in length and an endonuclease domain, wherein the repeat domain is engineered for recognition of a predetermined nucleotide sequence, and wherein the fusion protein recognizes the predetermined nucleotide sequence. In one embodiment, the cell is a eukaryotic cell. In another embodiment, the cell is an animal cell. In a further embodiment, the cell is a mammalian cell. In a still further embodiment, the cell is a human cell. In one embodiment, the cell is a plant cell. In another embodiment, the cell is a prokaryotic cell. In some embodiments, the fusion protein introduces an endonucleolytic cleavage in a nucleic acid of the cell, whereby the genome of the cell is modified.

Certain embodiments are directed to a composition for altering the DNA sequence of a cell in vivo comprising a nucleic acid, wherein the nucleic acid encodes a gene-editing protein. Other embodiments are directed to a composition for altering the DNA sequence of a cell in vivo comprising a nucleic-acid mixture, wherein the nucleic-acid mixture comprises: a first nucleic acid that encodes a first gene-editing protein, and a second nucleic acid that encodes a second gene-editing protein. In one embodiment, the binding site of the first gene-editing protein and the binding site of the second gene-editing protein are present in the same target DNA molecule. In another embodiment, the binding site of the first gene-editing protein and the binding site of the second gene-editing protein are separated by less than about 50 bases, or less than about 40 bases, or less than about 30 bases or less than about 20 bases, or less than about 10 bases, or between about 10 bases and about 25 bases or about 15 bases. In one embodiment, the nuclease domain of the first gene-editing protein and the nuclease domain of the second gene-editing protein are capable of forming a dimer. In another embodiment, the dimer is capable of generating a nick or double-strand break in a target DNA molecule.

Certain embodiments are directed to a therapeutic composition. Other embodiments are directed to a cosmetic composition. In some embodiments, the composition comprises a repair template. In a further embodiment, the repair template is a single-stranded DNA molecule or a double-stranded DNA molecule.

Other embodiments are directed to an article of manufacture for synthesizing a protein or a nucleic acid encoding a protein. In one embodiment, the article is a nucleic acid. In another embodiment, the protein comprises a DNA-binding domain. In a further embodiment, the nucleic acid comprises a nucleotide sequence encoding a DNA-binding domain. In one embodiment, the protein comprises a nuclease domain. In another embodiment, the nucleic acid comprises a nucleotide sequence encoding a nuclease domain. In one embodiment, the protein comprises a plurality of repeat sequences. In another embodiment, the nucleic acid encodes a plurality of repeat sequences. In a further embodiment, the nuclease domain is selected from: FokI, StsI, StsI-HA, StsI-HA2, StsI-UHA, StsI-UHA2, StsI-HF, and StsI-UHF or a natural or engineered variant or biologically active fragment thereof. In one embodiment, the nucleic acid comprises an RNA-polymerase promoter. In another embodiment, the RNA-polymerase promoter is a T7 promoter or a SP6 promoter. In a further embodiment, the nucleic acid comprises a viral promoter. In one embodiment, the nucleic acid comprises an untranslated region. In another embodiment, the nucleic acid is an in vitro-transcription template.

Certain embodiments are directed to a method for inducing a cell to express a protein in vivo. Other embodiments are directed to a method for altering the DNA sequence of a cell in vivo comprising transfecting the cell in vivo with a gene-editing protein or inducing the cell to express a gene-editing protein in vivo. Still other embodiments are directed to a method for reducing the expression of a protein of interest in a cell in vivo. In one embodiment, the cell is induced to express a gene-editing protein, wherein the gene-editing protein is capable of creating a nick or a double-strand break in a target DNA molecule. In another embodiment, the nick or double-strand break results in inactivation of a gene. Still other embodiments are directed to a method for generating an inactive, reduced-activity or dominant-negative form of a protein in vivo. In one embodiment, the protein is survivin. Still other embodiments are directed to a method for repairing one or more mutations in a cell in vivo. In one embodiment, the cell is contacted with a repair template. In another embodiment, the repair template is a DNA molecule. In a further embodiment, the repair template does not contain a binding site of the gene-editing protein. In a still further embodiment, the repair template encodes an amino-acid sequence that is encoded by a DNA sequence that comprises a binding site of the gene-editing protein.

In various embodiments, the repair template is about 20 nucleotides, or about 30 nucleotides, or about 40 nucleotides, or about 50 nucleotides, or about 60 nucleotides, or about 70 nucleotides, or about 80 nucleotides, or about 90 nucleotides, or about 100 nucleotides, or about 150 nucleotides, or about 200 nucleotides, or about 300 nucleotides, or about 400 nucleotides, or about 500 nucleotides, or about 750 nucleotides, or about 1000 nucleotides. In various embodiments, the repair template is about 20-1000 nucleotides, or about 20-500 nucleotides, or about 20-400 nucleotides, or about 20-200 nucleotides, or about 20-100 nucleotides, or about 80-100 nucleotides, or about 50-100 nucleotides.

In various embodiments, the mass ratio of RNA (e.g. synthetic RNA encoding gene-editing protein) to repair template is about 1:10, or about 1:9, or about 1:8, or about 1:7, or about 1:6, or about 1:5, or about 1:4, or about 1:3, or about 1:2, or about 1:1, or about 2:1, or about 3:1, or about 4:1, or about 5:1, or about 6:1, or about 7:1, or about 8:1, or about 9:1, or about 10:1.

In various embodiments, the molar ratio of RNA (e.g. synthetic RNA encoding gene-editing protein) to repair template is about 1:10, or about 1:9, or about 1:8, or about 1:7, or about 1:6, or about 1:5, or about 1:4, or about 1:3, or about 1:2, or about 1:1, or about 2:1, or about 3:1, or about 4:1, or about 5:1, or about 6:1, or about 7:1, or about 8:1, or about 9:1, or about 10:1.

In various embodiments, the repair template has a dual function, causing a repair to a gene-edited target sequence and preventing further binding of a gene-editing protein, thereby reducing or eliminating further gene-editing (e.g. via the repair template causing a repair that renders what was the gene-editing protein binding site no longer suitable for gene-editing protein binding). Accordingly, in some embodiments, the present gene-editing methods are tunable to ensure a single gene-edit per target site.

Other embodiments are directed to a method for treating a patient comprising administering to the patient a therapeutically or cosmetically effective amount of a protein or a nucleic acid encoding a protein. In one embodiment, the treatment results in one or more of the patient's symptoms being ameliorated. Certain embodiments are directed to a method for treating a patient comprising: a. inducing a cell to express a protein of interest by transfecting the cell in vivo with a nucleic acid encoding the protein of interest and/or b. reprogramming the cell in vivo. In one embodiment, the cell is reprogrammed to a less differentiated state. In another embodiment, the cell is reprogrammed by transfecting the cell with one or more synthetic RNA molecules encoding one or more reprogramming proteins. In a further embodiment, the cell is differentiated. In a still further embodiment, the cell is differentiated into one of: a skin cell, a glucose-responsive insulin-producing cell, a hematopoietic cell, a cardiac cell, a retinal cell, a renal cell, a neural cell, a stromal cell, a fat cell, a bone cell, a muscle cell, an oocyte, and a sperm cell. Other embodiments are directed to a method for treating a patient comprising: a. inducing a cell to express a gene-editing protein by transfecting the cell in vivo with a nucleic acid encoding a gene-editing protein and/or b. reprogramming the cell in vivo.

Other embodiments are directed to a complexation medium. In one embodiment, the complexation medium has a pH greater than about 7, or greater than about 7.2, or greater than about 7.4, or greater than about 7.6, or greater than about 7.8, or greater than about 8.0, or greater than about 8.2, or greater than about 8.4, or greater than about 8.6, or greater than about 8.8, or greater than about 9.0. In another embodiment, the complexation medium comprises transferrin. In a further embodiment, the complexation medium comprises DMEM. In a still further embodiment, the complexation medium comprises DMEM/F12. Still other embodiments are directed to a method for forming nucleic-acid-transfection-reagent complexes. In one embodiment, the transfection reagent is incubated with a complexation medium. In another embodiment, the incubation occurs before a mixing step. In a further embodiment, the incubation step is between about 5 seconds and about 5 minutes or between about 10 seconds and about 2 minutes or between about 15 seconds and about 1 minute or between about 30 seconds and about 45 seconds. In one embodiment, the transfection reagent is selected from Table 1. In another embodiment, the transfection reagent is a lipid or lipidoid. In a further embodiment, the transfection reagent comprises a cation. In a still further embodiment, the cation is a multivalent cation. In a still further embodiment, the transfection reagent is N1-[2-((1S)-1-[(3-aminopropyl)amino]-4-[di(3-amino-propyl)amino]butylcarboxamido)ethyl]-3,4-di[oleyloxy]-benzamide (a.k.a. MVL5) or a derivative thereof.

Certain embodiments are directed to a method for inducing a cell to express a protein by contacting the cell with a nucleic acid in vivo. In one embodiment, the cell is a mammalian cell. In another embodiment, the cell is a human cell or a rodent cell. Other embodiments are directed to a cell produced using one or more of the methods of the present invention. In one embodiment, the cell is present in a patient. In another embodiment, the cell is isolated from a patient. Other embodiments are directed to a screening library comprising a cell produced using one or more of the methods of the present invention. In one embodiment, the screening library is used for at least one of: toxicity screening, including: cardiotoxicity screening, neurotoxicity screening, and hepatotoxicity screening, efficacy screening, high-throughput screening, high-content screening, and other screening.

Other embodiments are directed to a kit containing a nucleic acid. In one embodiment, the kit contains a delivery reagent (a.k.a. "transfection reagent"). In another embodiment, the kit is a reprogramming kit. In a further embodiment, the kit is a gene-editing kit. Other embodiments are directed to a kit for producing nucleic acids. In one embodiment, the kit contains at least two of: pseudouridine-triphosphate, 5-methyluridine triphosphate, 5-methylcytidine triphosphate, 5-hydroxymethylcytidine triphosphate, N4-methylcytidine triphosphate, N4-acetylcytidine triphosphate, and 7-deazaguanosine triphosphate or one or more derivatives thereof. Other embodiments are directed to a therapeutic or cosmetic comprising a nucleic acid. In one embodiment, the therapeutic or cosmetic is a pharmaceutical composition. In another embodiment, the pharmaceutical composition is formulated. In a further embodiment, the formulation comprises an aqueous suspension of liposomes. Example liposome components are set forth in Table 1, and are given by way of example, and not by way of limitation. In one embodiment, the liposomes include one or more polyethylene glycol (PEG) chains. In another embodiment, the PEG is PEG2000. In a further embodiment, the liposomes include 1,2-distearoyl-sn-glycero-3-phosphoethanolamine (DSPE) or a derivative thereof. In one embodiment, the therapeutic comprises one or more ligands. In another embodiment, the therapeutic comprises at least one of: androgen, CD30 (TNFRSF8), a cell-penetrating peptide, CXCR, estrogen, epidermal growth factor, EGFR, HER2, folate, insulin, insulin-like growth factor-I, interleukin-13, integrin, progesterone, stromal-derived-factor-1, thrombin, vitamin D, and transferrin or a biologically active fragment or variant thereof. Still other embodiments are directed to a therapeutic or cosmetic comprising a cell generated using one or more of the methods of the present invention. In one embodiment, the therapeutic is administered to a patient for the treatment of any of the diseases or disorders described herein, including by way of non-limitation, type 1 diabetes, heart disease, including ischemic and dilated cardiomyopathy, macular degeneration, Parkinson's disease, cystic fibrosis, sickle-cell anemia, thalassemia, Fanconi anemia, severe combined immunodeficiency, hereditary sensory neuropathy, xeroderma pigmentosum, Huntington's disease, muscular dystrophy, amyotrophic lateral sclerosis, Alzheimer's disease, cancer, and infectious diseases including: hepatitis and HIV/AIDS.

Other embodiments are directed to a method for reprogramming a cell in vivo. In one embodiment, the cell is reprogrammed by contacting the cell with one or more nucleic acids. In one embodiment, the cell is contacted with a plurality of nucleic acids encoding at least one of: Oct4 protein, Sox2 protein, Klf4 protein, c-Myc protein, Lin28 protein or a biologically active fragment, variant or derivative thereof. In another embodiment, the cell is contacted with a plurality of nucleic acids encoding a plurality of proteins including: Oct4 protein, Sox2 protein, Klf4 protein, and c-Myc protein or one or more biologically active fragments, variants or derivatives thereof. Still other embodiments are directed to a method for gene editing a cell in vivo. In one embodiment, the cell is gene-edited by contacting the cell with one or more nucleic acids.

Certain embodiments are directed to a method for inducing a cell in vivo to express a protein of interest comprising contacting a cell in vivo with a solution comprising albumin that is treated with an ion-exchange resin or charcoal and one or more nucleic acid molecules, wherein at least one of the one or more nucleic acid molecules encodes a protein of interest. In one embodiment, the method results in the cell expressing the protein of interest. In another embodiment, the one or more nucleic acid molecules comprise a synthetic RNA molecule. In one embodiment, the cell is a skin cell. In another embodiment, the cell is a muscle cell. In yet another embodiment, the cell is a dermal fibroblast. In yet another embodiment, the cell is a myoblast. In one embodiment, the protein of interest is an extracellular matrix protein. In another embodiment, the protein of interest is selected from: elastin, collagen, laminin, fibronectin, vitronectin, lysyl oxidase, elastin binding protein, a growth factor, fibroblast growth factor, transforming growth factor beta, granulocyte colony-stimulating factor, a matrix metalloproteinase, an actin, fibrillin, microfibril-associated glycoprotein, a lysyl-oxidase-like protein, and platelet-derived growth factor. In one embodiment, the solution is delivered to the dermis. In another embodiment, the delivering is by injection. In yet another embodiment, the delivering is by injection using a microneedle array. In one embodiment, the solution further comprises a growth factor. In another embodiment, the growth factor is selected from: fibroblast growth factor and transforming growth factor beta. In yet another embodiment, the solution further comprises cholesterol. Other embodiments are directed a method for inducing a cell in vivo to express a protein of interest comprising contacting a cell in vivo with a solution comprising cholesterol and one or more nucleic acid molecules, wherein at least one of the one or more nucleic acid molecules encodes a protein of interest. In one embodiment, the method results in the cell expressing the protein of interest. Still other embodiments are directed to a method for transfecting a cell in vivo with a nucleic acid molecule comprising contacting a cell in vivo with a solution comprising albumin that is treated with an ion-exchange resin or charcoal and a nucleic acid molecule. In one embodiment, the method results in the cell being transfected with the nucleic acid molecule. In another embodiment, the nucleic acid molecule is one of: a dsDNA molecule, a ssDNA molecule, a dsRNA molecule, a ssRNA molecule, a plasmid, an oligonucleotide, a synthetic RNA molecule, a miRNA molecule, an mRNA molecule, an siRNA molecule. Still other embodiments are directed to a method for treating a patient comprising delivering to a patient a composition comprising albumin that is treated with an ion-exchange resin or charcoal and one or more nucleic acid molecules, wherein at least one of the one or more nucleic acid molecules encodes a protein of interest. In one embodiment, the method results in the expression of the protein of interest in the patient. In another embodiment, the method results in the expression of the protein of interest in the dermis of the patient.

Certain embodiments are directed to a cosmetic composition comprising albumin that is treated with an ion-exchange resin or charcoal and a nucleic acid molecule. Other embodiments are directed to a cosmetic treatment article. In one embodiment, the cosmetic treatment article comprises a device configured to deliver a composition to a patient. In another embodiment, the nucleic acid molecule encodes elastin protein or collagen protein. Still other embodiments are directed to a solution for transfecting a cell in vivo comprising cholesterol or a cholesterol analog and one or more nucleic acid molecules. In one embodiment, the cholesterol or cholesterol analog is covalently bound to at least one of the one or more nucleic acid molecules. In another embodiment, the cholesterol analog is an oxysterol. In yet another embodiment, the cholesterol analog includes one or more of: an A-ring substitution, a B-ring substitution, a D-ring substitution, a side-chain substitution, a cholestanoic acid, a cholestenoic acid, a polyunsaturated moiety, a deuterated moiety, a fluorinated moiety, a sulfonated moiety, a phosphorylated moiety, and a fluorescent moiety. In yet another embodiment, the method comprises treating the patient with one or more of: a dermal filler, a neurotoxin (by way of illustration sodium channel inhibitors (e.g., tetrodotoxin), potassium channel inhibitors (e.g., tetraethylammonium), chloride channel inhibitors (e.g., chlorotoxin and curare), calcium channel inhibitors (e.g., conotoxin), synaptic vesicle release inhibitors (e.g., botulinum toxin and tetanus toxin) and blood brain barrier inhibitor (e.g., aluminum and mercury)) and a repair-inducing treatment.

Despite the tendency of transfection reagent nucleic acid complexes to precipitate, form clumps or otherwise degrade when stored for more than a few minutes, the present inventors have surprisingly discovered that transfection reagent nucleic acid complexes produced according to some embodiments of the present invention can be frozen and/or can be stored at various temperatures, including room temperature, about 4° C., about −20° C., about −80° C., and about −196° C. for an extended period of time, for example, for several hours, about 1 day, about 1 week, about 1 month, about 1 year, and longer than about 1 year. Some embodiments are therefore directed to a pharmaceutical formulation comprising synthetic RNA and a transfection reagent, wherein the pharmaceutical formulation is provided in solid form. Other embodiments are directed to a pharmaceutical formulation comprising synthetic RNA transfection reagent complexes, wherein the synthetic RNA transfection reagent complexes are provided in solid form. In various embodiments, the synthetic RNA transfection reagent complexes are provided in frozen form. Various embodiments are directed to a method for stabilizing nucleic acid transfection reagent complexes comprising forming nucleic acid transfection reagent complexes and contacting the nucleic acid transfection reagent complexes or vessel in which such are contained with a cryogenic liquid to produce stabilized nucleic acid transfection reagent complexes. In one embodiment, the nucleic acid transfection reagent complexes are stabilized for shipment or storage.

Illustrative subjects or patients refers to any vertebrate including, without limitation, humans and other primates (e.g., chimpanzees and other apes and monkey species), farm animals (e.g., cattle, sheep, pigs, goats, and horses), domestic mammals (e.g., dogs and cats), laboratory animals (e.g., rodents such as mice, rats, and guinea pigs), and birds (e.g., domestic, wild and game birds such as chickens, turkeys and other gallinaceous birds, ducks, geese, and the like). In some embodiments, the subject is a mammal. In some embodiments, the subject is a human.

Definitions

By "molecule" is meant a molecular entity (molecule, ion, complex, etc.).

By "RNA molecule" is meant a molecule that comprises RNA.

By "synthetic RNA molecule" is meant an RNA molecule that is produced outside of a cell or that is produced inside of a cell using bioengineering, by way of non-limiting example, an RNA molecule that is produced in an in vitro-transcription reaction, an RNA molecule that is produced by direct chemical synthesis or an RNA molecule that is produced in a genetically-engineered *E. coli* cell.

By "transfection" is meant contacting a cell with a molecule, wherein the molecule is internalized by the cell.

By "upon transfection" is meant during or after transfection.

By "transfection reagent" is meant a substance or mixture of substances that associates with a molecule and facilitates the delivery of the molecule to and/or internalization of the molecule by a cell, by way of non-limiting example, a cationic lipid, a charged polymer or a cell-penetrating peptide.

By "reagent-based transfection" is meant transfection using a transfection reagent.

By "medium" is meant a solvent or a solution comprising a solvent and a solute, by way of non-limiting example, Dulbecco's Modified Eagle's Medium (DMEM), DMEM+ 10% fetal bovine serum (FBS), saline or water.

By "complexation medium" is meant a medium to which a transfection reagent and a molecule to be transfected are added and in which the transfection reagent associates with the molecule to be transfected.

By "transfection medium" is meant a medium that can be used for transfection, by way of non-limiting example, Dulbecco's Modified Eagle's Medium (DMEM), DMEM/ F12, saline or water.

By "recombinant protein" is meant a protein or peptide that is not produced in animals or humans. Non-limiting examples include human transferrin that is produced in bacteria, human fibronectin that is produced in an in vitro culture of mouse cells, and human serum albumin that is produced in a rice plant.

By "Oct4 protein" is meant a protein that is encoded by the POU5F1 gene, or a natural or engineered variant, family-member, orthologue, fragment or fusion construct thereof, by way of non-limiting example, human Oct4 protein (SEQ ID NO: 8), mouse Oct4 protein, Oct1 protein, a protein encoded by POU5F1 pseudogene 2, a DNA-binding domain of Oct4 protein or an Oct4-GFP fusion protein. In some embodiments the Oct4 protein comprises an amino acid sequence that has at least 70% identity with SEQ ID NO: 8, or in other embodiments, at least 75%, 80%, 85%, 90%, or 95% identity with SEQ ID NO: 8. In some embodiments, the Oct4 protein comprises an amino acid sequence having from 1 to 20 amino acid insertions, deletions, or substitutions (collectively) with respect to SEQ ID NO: 8. Or in other embodiments, the Oct4 protein comprises an amino acid sequence having from 1 to 15 or from 1 to 10 amino acid insertions, deletions, or substitutions (collectively) with respect to SEQ ID NO: 8.

By "Sox2 protein" is meant a protein that is encoded by the SOX2 gene, or a natural or engineered variant, family-member, orthologue, fragment or fusion construct thereof, by way of non-limiting example, human Sox2 protein (SEQ ID NO: 9), mouse Sox2 protein, a DNA-binding domain of Sox2 protein or a Sox2-GFP fusion protein. In some embodiments the Sox2 protein comprises an amino acid sequence that has at least 70% identity with SEQ ID NO: 9, or in other embodiments, at least 75%, 80%, 85%, 90%, or 95% identity with SEQ ID NO: 9. In some embodiments, the Sox2 protein comprises an amino acid sequence having from 1 to 20 amino acid insertions, deletions, or substitutions (collectively) with respect to SEQ ID NO: 9. Or in other embodiments, the Sox2 protein comprises an amino acid sequence having from 1 to 15 or from 1 to 10 amino acid insertions, deletions, or substitutions (collectively) with respect to SEQ ID NO: 9.

By "Klf4 protein" is meant a protein that is encoded by the KLF4 gene, or a natural or engineered variant, family-member, orthologue, fragment or fusion construct thereof, by way of non-limiting example, human Klf4 protein (SEQ ID NO: 10), mouse Klf4 protein, a DNA-binding domain of Klf4 protein or a Klf4-GFP fusion protein. In some embodiments the Klf4 protein comprises an amino acid sequence that has at least 70% identity with SEQ ID NO: 10, or in other embodiments, at least 75%, 80%, 85%, 90%, or 95% identity with SEQ ID NO: 10. In some embodiments, the Klf4 protein comprises an amino acid sequence having from 1 to 20 amino acid insertions, deletions, or substitutions (collectively) with respect to SEQ ID NO: 10. Or in other embodiments, the Klf4 protein comprises an amino acid sequence having from 1 to 15 or from 1 to 10 amino acid insertions, deletions, or substitutions (collectively) with respect to SEQ ID NO: 10.

By "c-Myc protein" is meant a protein that is encoded by the MYC gene, or a natural or engineered variant, family-member, orthologue, fragment or fusion construct thereof, by way of non-limiting example, human c-Myc protein (SEQ ID NO: 11), mouse c-Myc protein, l-Myc protein, c-Myc (T58A) protein, a DNA-binding domain of c-Myc protein or a c-Myc-GFP fusion protein. In some embodiments the c-Myc protein comprises an amino acid sequence that has at least 70% identity with SEQ ID NO: 11, or in other embodiments, at least 75%, 80%, 85%, 90%, or 95% identity with SEQ ID NO: 11. In some embodiments, the c-Myc protein comprises an amino acid having from 1 to 20 amino acid insertions, deletions, or substitutions (collectively) with respect to SEQ ID NO: 11. Or in other embodiments, the c-Myc protein comprises an amino acid sequence having from 1 to 15 or from 1 to 10 amino acid insertions, deletions, or substitutions (collectively) with respect to SEQ ID NO: 11.

By "erythropoietin" or "erythropoietin protein" is meant a protein that is encoded by the EPO gene, or a natural or engineered variant, family-member, orthologue, fragment or fusion construct thereof, by way of non-limiting example, human erythropoietin (SEQ ID NO: 164), mouse erythropoietin, darbepoetin, darbepoetin alfa, NOVEPOETIN, a binding domain of erythropoietin or an erythropoietin-GFP fusion protein. In some embodiments the erythropoietin comprises an amino acid sequence that has at least 70% identity with SEQ ID NO: 164, or in other embodiments, at least 75%, 80%, 85%, 90%, or 95% identity with SEQ ID NO: 164. In some embodiments, the erythropoietin comprises an amino acid sequence having from 1 to 20 amino acid insertions, deletions, or substitutions (collectively) with respect to SEQ ID NO: 164. Or in other embodiments, the erythropoietin comprises an amino acid sequence having from 1 to 15 or from 1 to 10 amino acid insertions, deletions, or substitutions (collectively) with respect to SEQ ID NO: 164.

By "reprogramming" is meant causing a change in the phenotype of a cell, by way of non-limiting example, causing a β-cell progenitor to differentiate into a mature β-cell, causing a fibroblast to dedifferentiate into a pluripotent stem cell, causing a keratinocyte to transdifferentiate into a cardiac stem cell, causing the telomeres of a cell to lengthen or causing the axon of a neuron to grow.

By "reprogramming factor" is meant a molecule that, when a cell is contacted with the molecule and/or the cell expresses the molecule, can, either alone or in combination with other molecules, cause reprogramming, by way of non-limiting example, Oct4 protein, Tert protein or erythropoietin.

By "germ cell" is meant a sperm cell or an egg cell.

By "pluripotent stem cell" is meant a cell that can differentiate into cells of all three germ layers (endoderm, mesoderm, and ectoderm) in vivo.

By "somatic cell" is meant a cell that is not a pluripotent stem cell or a germ cell, by way of non-limiting example, a skin cell.

By "hematopoietic cell" is meant a blood cell or a cell that can differentiate into a blood cell, by way of non-limiting example, a hematopoietic stem cell or a white blood cell.

By "cardiac cell" is meant a heart cell or a cell that can differentiate into a heart cell, by way of non-limiting example, a cardiac stem cell or a cardiomyocyte.

By "retinal cell" is meant a cell of the retina or a cell that can differentiate into a cell of the retina, by way of non-limiting example, a retinal pigmented epithelial cell.

By "skin cell" is meant a cell that is normally found in the skin, by way of non-limiting example, a fibroblast, a keratinocyte, a melanocyte, an adipocyte, a mesenchymal stem cell, an adipose stem cell or a blood cell.

By "immunosuppressant" is meant a substance that can suppress one or more aspects of an immune system, and that is not normally present in a mammal, by way of non-limiting example, B18R or dexamethasone.

By "single-strand break" is meant a region of single-stranded or double-stranded DNA in which one or more of the covalent bonds linking the nucleotides has been broken in one of the one or two strands.

By "double-strand break" is meant a region of double-stranded DNA in which one or more of the covalent bonds linking the nucleotides has been broken in each of the two strands.

By "nucleotide" is meant a nucleotide or a fragment or derivative thereof, by way of non-limiting example, a nucleobase, a nucleoside, a nucleotide-triphosphate, etc.

By "nucleoside" is meant a nucleotide or a fragment or derivative thereof, by way of non-limiting example, a nucleobase, a nucleoside, a nucleotide-triphosphate, etc.

By "gene editing" is meant altering the DNA sequence of a cell, by way of non-limiting example, by transfecting the cell with a protein that causes a mutation in the DNA of the cell.

By "gene-editing protein" is meant a protein that can, either alone or in combination with one or more other molecules, alter the DNA sequence of a cell, by way of non-limiting example, a nuclease, a transcription activator-like effector nuclease (TALEN), a zinc-finger nuclease, a meganuclease, a nickase, a clustered regularly interspaced short palindromic repeat (CRISPR)-associated protein or a natural or engineered variant, family-member, orthologue, fragment or fusion construct thereof.

By "repair template" is meant a nucleic acid containing a region of at least about 70% homology with a sequence that is within 10 kb of a target site of a gene-editing protein.

By "repeat sequence" is meant an amino-acid sequence that is present in more than one copy in a protein, to within at least about 10% homology, by way of non-limiting example, a monomer repeat of a transcription activator-like effector.

By "DNA-binding domain" is meant a region of a molecule that is capable of binding to a DNA molecule, by way of non-limiting example, a protein domain comprising one or more zinc fingers, a protein domain comprising one or more transcription activator-like (TAL) effector repeat sequences or a binding pocket of a small molecule that is capable of binding to a DNA molecule.

By "binding site" is meant a nucleic-acid sequence that is capable of being recognized by a gene-editing protein, DNA-binding protein, DNA-binding domain or a biologically active fragment or variant thereof or a nucleic-acid sequence for which a gene-editing protein, DNA-binding protein, DNA-binding domain or a biologically active fragment or variant thereof has high affinity, by way of non-limiting example, an about 20-base-pair sequence of DNA in exon 1 of the human BIRC5 gene.

By "target" is meant a nucleic acid that contains a binding site.

Other definitions are set forth in U.S. application Ser. No. 13/465,490, U.S. Provisional Application No. 61/664,494, U.S. Provisional Application No. 61/721,302, International Application No. PCT/US12/67966, U.S. Provisional Application No. 61/785,404, U.S. Provisional Application No. 61/842,874, International Application No. PCT/US13/68118, U.S. Provisional Application No. 61/934,397, U.S. application Ser. No. 14/296,220, U.S. Provisional Application No. 62/038,608, U.S. Provisional Application No. 62/069,667, and International Application No. PCT/US2015/013949, the contents of which are hereby incorporated by reference in their entireties.

Selected Sequences

| SEQ ID NO | Description |
|---|---|
| 1 | StsI |
| 2 | StsI-HA |
| 3 | StsI-HA2 |
| 4 | StsI-UHA |
| 5 | StsI-UHA2 |
| 6 | StsI-HF |
| 7 | StsI-UHF |
| 8 | Oct4 |
| 9 | Sox2 |
| 10 | Klf4 |
| 11 | c-Myc |
| 12 | BIRC5_exon1 |
| 13 | BIRC5_exon2 |
| 14 | BIRC5_exon3 |
| 15 | BIRC5_exon4 |

-continued

| SEQ ID NO | Description |
|---|---|
| 16 | BIRC5-1.1-L |
| 17 | BIRC5-1.1-R |
| 18 | BIRC5-1.2-L |
| 19 | BIRC5-1.2-R |
| 20 | BIRC5-1.3-L |
| 21 | BIRC5-1.3-R |
| 22 | BIRC5-2.1-L |
| 23 | BIRC5-2.1-R |
| 24 | BIRC5-2.2-L |
| 25 | BIRC5-2.2-R |
| 26 | BIRC5-3.1-L |
| 27 | BIRC5-3.1-R |
| 28 | CDK1 |
| 29 | CDK2 |
| 30 | CDK3 |
| 31 | CDK4 |
| 32 | CDK5 |
| 33 | CDK6 |
| 34 | BIRC5 |
| 35 | HIF1A |
| 36 | RRM2 |
| 37 | KRAS |
| 38 | EGFR |
| 39 | MYC |
| 40 | PKN3 |
| 41 | KIF11 |
| 42 | APC |
| 43 | BRCA1 |
| 44 | BRCA2 |
| 45 | TP53 |
| 46 | APP |
| 47 | HTT |
| 48 | IAPP |
| 49 | MAPT |
| 50 | PRNP |
| 51 | SNCA |
| 52 | SOD1 |
| 53 | FokI |

-continued

| SEQ ID NO | Description |
|---|---|
| 54 | Repeat1 |
| 55 | Repeat2 |
| 56 | Repeat3 |
| 57 | EO-GHGG-FokI ("GHGG" disclosed as SEQ ID NO: 547) |
| 58 | GHGG-FokI ("GHGG" disclosed as SEQ ID NO: 547) |
| 59 | EO-GHGG-StsI ("GHGG" disclosed as SEQ ID NO: 547) |
| 60 | GHGG-StsI ("GHGG" disclosed as SEQ ID NO: 547) |
| 61 | collagen alpha-1(I) chain preproprotein |
| 62 | collagen alpha-2(I) chain precursor |
| 63 | collagen alpha-1(II) chain isoform 1 precursor |
| 64 | collagen alpha-1(II) chain isoform 2 precursor |
| 65 | collagen alpha-1(III) chain preproprotein |
| 66 | collagen alpha-1(IV) chain preproprotein |
| 67 | collagen alpha-2(IV) chain preproprotein |
| 68 | collagen alpha-3(IV) chain precursor |
| 69 | collagen alpha-4(IV) chain precursor |
| 70 | collagen alpha-5(IV) chain isoform 1 precursor |
| 71 | collagen alpha-6(IV) chain isoform A precursor |
| 72 | collagen alpha-1(V) chain isoform 1 preproprotein |
| 73 | collagen alpha-2(V) chain preproprotein |
| 74 | collagen alpha-3(V) chain preproprotein |
| 75 | collagen alpha-1(VI) chain precursor |
| 76 | collagen alpha-2(VI) chain isoform 2C2 precursor |
| 77 | collagen alpha-3(VI) chain isoform 1 precursor |
| 78 | collagen alpha-1(VII) chain precursor |
| 79 | elastin isoform a precursor |
| 80 | elastin isoform b precursor |
| 81 | elastin isoform c precursor |
| 82 | elastin isoform d precursor |
| 83 | elastin isoform e precursor |
| 84 | elastin isoform f precursor |
| 85 | elastin isoform g precursor |
| 86 | elastin isoform h precursor |
| 87 | elastin isoform i precursor |
| 88 | elastin isoform j precursor |
| 89 | elastin isoform k precursor |
| 90 | elastin isoform l precursor |
| 91 | elastin isoform m precursor |
| 92 | protein-lysine 6-oxidase isoform 1 preproprotein |

| SEQ ID NO | Description |
|---|---|
| 93 | protein-lysine 6-oxidase isoform 2 |
| 94 | telomerase reverse transcriptase isoform 1 |
| 95 | telomerase reverse transcriptase isoform 2 |
| 96 | fibronectin isoform 1 preproprotein |
| 97 | fibronectin isoform 3 preproprotein |
| 98 | fibronectin isoform 4 preproprotein |
| 99 | fibronectin isoform 5 preproprotein |
| 100 | fibronectin isoform 6 preproprotein |
| 101 | fibronectin isoform 7 preproprotein |
| 102 | vitronectin precursor |
| 103 | nidogen-1 precursor |
| 104 | laminin subunit alpha-1 precursor |
| 105 | insulin-like growth factor I isoform 1 preproprotein |
| 106 | fibroblast growth factor 1 isoform 1 precursor |
| 107 | fibroblast growth factor 2 |
| 108 | transforming growth factor beta-1 precursor |
| 109 | transforming growth factor beta-2 isoform 1 precursor |
| 110 | transforming growth factor beta-2 isoform 2 precursor |
| 111 | actin, alpha skeletal muscle |
| 112 | actin, aortic smooth muscle |
| 113 | actin, cytoplasmic 1 |
| 114 | actin, alpha cardiac muscle 1 proprotein |
| 115 | actin, cytoplasmic 2 |
| 116 | actin, gamma-enteric smooth muscle isoform 1 precursor |
| 117 | actin, gamma-enteric smooth muscle isoform 2 precursor |
| 118 | granulocyte colony-stimulating factor isoform a precursor |
| 119 | granulocyte colony-stimulating factor isoform b precursor |
| 120 | granulocyte colony-stimulating factor isoform c precursor |
| 121 | granulocyte colony-stimulating factor isoform d precursor |
| 122 | platelet-derived growth factor subunit A isoform 1 preproprotein |
| 123 | platelet-derived growth factor subunit A isoform 2 preproprotein |
| 124 | platelet-derived growth factor subunit B isoform 1 preproprotein |
| 125 | platelet-derived growth factor subunit B isoform 2 preproprotein |
| 126 | platelet-derived growth factor C precursor |
| 127 | platelet-derived growth factor D isoform 1 precursor |
| 128 | platelet-derived growth factor D isoform 2 precursor |
| 129 | interstitial collagenase isoform 1 preproprotein |
| 130 | interstitial collagenase isoform 2 |

| SEQ ID NO | Description |
|---|---|
| 131 | neutrophil collagenase preproprotein |
| 132 | stromelysin-2 preproprotein |
| 133 | macrophage metalloelastase preproprotein |
| 134 | fibrillin-1 precursor |
| 135 | fibrillin-2 precursor |
| 136 | lysyl oxidase homolog 1 preproprotein |
| 137 | lysyl oxidase homolog 2 precursor |
| 138 | lysyl oxidase homolog 3 isoform 1 precursor |
| 139 | lysyl oxidase homolog 3 isoform 2 precursor |
| 140 | lysyl oxidase homolog 3 isoform 3 |
| 141 | lysyl oxidase homolog 4 precursor |
| 142 | microfibrillar-associated protein 2 isoform a precursor |
| 143 | microfibrillar-associated protein 2 isoform b precursor |
| 144 | microfibrillar-associated protein 5 precursor |
| 145 | disintegrin and metalloproteinase domain-containing protein 17 preprotein |
| 146 | desmoglein-2 preproprotein |
| 147 | DNA polymerase eta isoform 1 |
| 148 | DNA polymerase eta isoform 2 |
| 149 | DNA polymerase eta isoform 3 |
| 150 | ferrochelatase, mitochondrial isoform a precursor |
| 151 | ferrochelatase, mitochondrial isoform b precursor |
| 152 | filaggrin |
| 153 | hyaluronan synthase 1 isoform 1 |
| 154 | hyaluronan synthase 1 isoform 2 |
| 155 | hyaluronan synthase 2 |
| 156 | hyaluronan synthase 3 isoform a |
| 157 | hyaluronan synthase 3 isoform b |
| 158 | proopiomelanocortin |
| 159 | plakophilin-1 isoform 1a |
| 160 | plakophilin-1 isoform 1b |
| 161 | retinol dehydrogenase 10 |
| 162 | mitochondrial brown fat uncoupling protein 1 |
| 163 | tyrosinase precursor |
| 164 | erythropoietin |
| 165 | epoetin alfa |
| 166 | darbepoetin alfa |
| 167 | NOVEPOETIN |
| 168 | NOVECRIT |

This invention is further illustrated by the following non-limiting examples.

EXAMPLES

Example 1 RNA Synthesis

RNA encoding green fluorescent protein ("GFP"), NOVEPOETIN ("EPO"), elastin ("ELN"), tyrosinase ("TYR"), melanocortin-1-receptor ("MC1R"), HAS1, HAS2, HAS3, COL3A1, COL7A1, COL1A1, COL1A2, hTERT, Holly GFP, Fresno RFP, Blitzen Blue, RIBOSLICE gene-editing proteins, TALENs, Cas9, Oct4, Sox2, Klf4, c-Myc-2 (T58A), Lin28, IL2, IL6, IL15, IL22, BMP2, BDNF, LIF, BMP6, IL15RA, FGF21, LIF, and PTH, and comprising various combinations of canonical and non-canonical nucleotides, was synthesized from DNA templates using the T7 High Yield RNA Synthesis Kit and the Vaccinia Capping System kit with mRNA Cap 2'-O-Methyltransferase (all from New England Biolabs, Inc.), according to the manufacturer's instructions and the present inventors' previously disclosed inventions (U.S. application Ser. No. 13/465,490 (now U.S. Pat. No. 8,497,124), International Application No. PCT/US12/67966, U.S. application Ser. No. 13/931,251, International Application No. PCT/US13/68118, and International Application No. PCT/US2015/013949, the contents of all of which are hereby incorporated by reference in their entirety) (Table 4). The RNA was then diluted with nuclease-free water to between 100 ng/µL and 2000 ng/µL. For certain experiments, an RNase inhibitor (Superase•In, Life Technologies Corporation) was added at a concentration of 1 µL/100 µg of RNA. RNA solutions were stored at room temperature, 4 C, −20 C or −80 C. For reprogramming experiments, RNA encoding Oct4, Sox2, Klf4, c-Myc-2 (T58A), and Lin28 was mixed at a molar ratio of 3:1:1:1:1.

TABLE 4

RNA Synthesis

| Template | Nucleotides | Reaction Volume/µL | ivT Yield/µg |
|---|---|---|---|
| ELN | A, 0.5 7dG, 0.4 5mU, 5mC | 20 | 34.1 |
| ELN | A, 0.5 7dG, 0.4 5mU, 5mC | 20 | 67.6 |
| GFP | A, 0.5 7dG, 0.4 5mU, 5mC | 10 | 60.5 |
| GFP | A, 0.5 7dG, 0.4 5mU, 5hmC | 10 | 25.5 |
| GFP | A, G, U, 5hmC | 10 | 58.3 |
| GFP | A, 0.5 7dG, U, 5hmC | 10 | 47.3 |
| GFP | A, 0.5 7dG, 0.4 5mU, 5cC | 10 | 33.8 |
| GFP | A, G, U, 5hmC | 15 | 30.3 |
| GFP | A, G, U, 5hmC | 15 | 44.6 |
| GFP | A, G, U, 5hmC | 15 | 24.7 |
| TYR | A, G, U, 5hmC | 15 | 45.4 |
| MC1R | A, G, U, 5hmC | 15 | 47.5 |
| TYR | A, G, U, C | 20 | 67.0 |
| TYR | A, G, psU, C | 20 | 93.7 |
| TYR | A, G, 0.4 5mU, C | 20 | 85.7 |
| TYR | A, G, U, 5mC | 20 | 73.4 |
| TYR | A, G, U, 5hmC | 20 | 72.7 |
| TYR | A, 0.5 7dG, U, C | 20 | 62.7 |
| TYR | A, G, psU, 5mC | 20 | 116.3 |
| TYR | A, G, psU, 5hmC | 20 | 102.4 |
| TYR | A, 0.5 7dG, psU, C | 20 | 87.3 |
| TYR | A, G, 0.4 5mU, 5mC | 20 | 106.5 |
| TYR | A, G, 0.4 5mU, 5hmC | 20 | 85.0 |
| TYR | A, 0.5 7dG, 0.4 5mU, C | 20 | 70.9 |
| TYR | A, 0.5 7dG, U, 5mC | 20 | 88.5 |
| TYR | A, 0.5 7dG, U, 5hmC | 20 | 59.1 |
| TYR | A, 0.5 7dG, psU, 5mC | 20 | 7.8 |
| TYR | A, 0.5 7dG, psU, 5hmC | 20 | 98.0 |
| TYR | A, 0.5 7dG, 0.4 5mU, 5mC | 20 | 106.5 |
| TYR | A, 0.5 7dG, 0.4 5mU, 5hmC | 20 | 82.3 |
| HAS1 | A, G, U, 5hmC | 20 | 178.4 |
| HAS2 | A, G, U, 5hmC | 20 | 59.3 |
| HAS3 | A, G, U, 5hmC | 20 | 102.6 |
| TYR | A, G, 0.4 5mU, 5hmC | 100 | 377.3 |
| COL3A1 | A, G, 0.4 5mU, 5hmC | 20 | 108.3 |
| COL7A1 | A, G, 0.4 5mU, 5hmC | 20 | 94.6 |
| COL1A1 (20 µL) | A, G, 0.4 5mU, 5hmC | 20 | 114.0 |
| COL1A2 (10 µL) | A, G, 0.4 5mU, 5hmC | 10 | 31.3 |
| TYR | A, G, 0.4 5mU, 5hmC | 100 | 249.9 |
| GFP | A, G, 0.4 5mU, 5hmC | 100 | 264.0 |
| hTERT | A, G, 0.4 5mU, 5hmC | 100 | 349.2 |
| GFP | A, G, U, 5hC | 20 | 81.7 |
| GFP | A, G, U, 0.5 5hC | 20 | 65.4 |
| GFP | A, sG, U, C | 20 | 34.7 |
| GFP | A, 0.5 sG, U, C | 20 | 47.5 |
| GFP | A, G, 5hmU, C | 20 | 22.1 |
| GFP | A, G, 0.5 5hmU, C | 20 | 28.4 |
| GFP | A, G, 5cU, C | 20 | 24.4 |
| GFP | A, G, 0.5 5cU, C | 20 | 28.4 |
| GFP | A, G, 5moU, C | 20 | 39.2 |
| GFP | A, G, 0.5 5moU, C | 20 | 34.2 |
| GFP | A, G, U, C | 20 | 42.0 |
| GFP | A, G, 5moU, C | 20 | 53.8 |
| GFP | A, G, 5moU, 5hmC | 20 | 101.5 |
| GFP | A, G, 0.4 5mU, 0.6 5moU, C | 20 | 98.6 |
| GFP | A, G, 0.4 5mU, C | 20 | 99.6 |
| GFP | A, G, U, 5mC | 20 | 106.1 |
| GFP | A, G, U, C | 20 | 85.7 |
| GFP | A, G, 5moU, C | 100 | 398.4 |
| hTERT | A, G, 5moU, C | 20 | 82.6 |
| COL7A1 | A, G, 5moU, C | 20 | 34.9 |
| COL7A1 | A, G, 5moU, C | 100 | 342.0 |
| Holly GFP | A, G, 5moU, C | 20 | 36.7 |
| Fresno RFP | A, G, 5moU, C | 20 | 72.0 |
| Blitzen Blue | A, G, 5moU, C | 20 | 30.3 |
| hTERT | A, G, 5moU, C | 20 | 49.6 |
| Cas9 | A, G, 5moU, C | 20 | 31.6 |
| EPO | A, G, U, C | 20 | 101.0 |
| EPO | A, G, 5moU, C | 20 | 52.9 |
| EPO | A, G, psU, C | 20 | 106.0 |
| COL7A1 | A, G, 5moU, C | 20 | 80.2 |
| Oct4 (SEQ ID NO: 8) | A, G, 5moU, C | 300 | 1925.5 |
| Sox2 (SEQ ID NO: 9) | A, G, 5moU, C | 100 | 641.8 |
| Klf4 (SEQ ID NO: 10) | A, G, 5moU, C | 100 | 739.0 |
| c-Myc-2 (T58A) | A, G, 5moU, C | 100 | 574.0 |
| Lin28 | A, G, 5moU, C | 100 | 556.0 |
| IL2 | A, G, 5moU, C | 20 | 62.4 |
| IL6 | A, G, 5moU, C | 20 | 22.2 |
| IL15 | A, G, 5moU, C | 20 | 50.4 |
| IL22 | A, G, 5moU, C | 20 | 63.6 |
| BMP2 | A, G, 5moU, C | 20 | 83.2 |
| BDNF | A, G, 5moU, C | 20 | 45.0 |
| LIF | A, G, 5moU, C | 20 | 54.0 |
| BMP6 | A, G, 5moU, C | 20 | 92.2 |
| IL15RA | A, G, 5moU, C | 20 | 91.4 |
| FGF21 | A, G, 5moU, C | 20 | 79.2 |
| GFP | A, G, 5moU, C | 40 | 181.0 |
| IL2 | A, G, 5moU, C | 30 | 99.4 |
| IL6 | A, G, 5moU, C | 30 | 31.2 |
| IL15 | A, G, 5moU, C | 30 | 89.8 |
| IL22 | A, G, 5moU, C | 30 | 104.0 |
| BDNF | A, G, 5moU, C | 30 | 95.9 |
| BMP2 | A, G, 5moU, C | 30 | 112.0 |

TABLE 4-continued

RNA Synthesis

| Template | Nucleotides | Reaction Volume/μL | ivT Yield/ μg |
|---|---|---|---|
| LIF | A, G, 5moU, C | 30 | 116.0 |
| PTH | A, G, 5moU, C | 30 | 88.4 |
| EPO | A, G, 5moU, C | 30 | 83.3 |

"A" refers to adenosine-5'-triphosphate,
"G" refers to guanosine-5'-triphosphate,
"U" refers to uridine-5'-triphosphate,
"C" refers to cytidine-5'-triphosphate,
"7dG" refers to 7-deazaguanosine-5'-triphosphate,
"sG" refers to thienoguanosine-5'-triphosphate,
"5mC" refers to 5-methylcytidine-5'-triphosphate,
"5hmC" refers to 5-hydroxymethylcytidine-5'-triphosphate,
"5cC" refers to 5-carboxycytidine-5'-triphosphate,
"5fC" refers to 5-formylcytidine-5'-triphosphate,
"5hC" refers to 5-hydroxycytidine-5'-triphosphate,
"psU" refers to 5-pseudouridine-5'-triphosphate,
"5mU" refers to 5-methyluridine-5'-triphosphate,
"5hmU" refers to 5-hydroxymethyluridine-5'-triphosphate,
"5cU" refers to 5-carboxyuridine-5'-triphosphate, and
"5moU" refers to 5-methoxyuridine-5'-triphosphate.

Example 2 Preparation of RNA-Transfection-Reagent Complexes

For each microgram of RNA, 1 μg RNA and 1 μL transfection reagent (LIPOFECTAMINE 3000, Life Technologies Corporation) were first diluted separately in complexation medium (Opti-MEM, Life Technologies Corporation or DMEM/F12+10 μg/mL insulin+5.5 μg/mL transferrin+6.7 ng/mL sodium selenite+2 μg/mL ethanolamine) to a total volume of between 5 μL and 100 μL each. Diluted RNA and transfection reagent were then mixed and incubated for 10 min at room temperature, according to the transfection reagent-manufacturer's instructions.

Example 3 Transfection of Cells with Synthetic RNA

Complexes were prepared according to Example 2, and were then added directly to cells in culture. For transfection in 6-well plates, between 10 μL and 250 μL of complexes were added to each well of the 6-well plate, which already contained 2 mL of transfection medium per well. Plates were shaken gently to distribute the complexes throughout the well. Cells were incubated with complexes for 4 hours to overnight, before replacing the medium with fresh transfection medium (2 mL/well). Alternatively, the medium was not replaced. Volumes were scaled for transfection in 24-well and 96-well plates.

Example 4 Toxicity of and Protein Translation from Synthetic RNA Containing Non-Canonical Nucleotides Primary human fibroblasts were transfected according to Example 2, using RNA synthesized according to Example 1. Cells were fixed and stained 20-24 h after transfection using an antibody against Oct4. The relative toxicity of the RNA was determined by assessing cell density at the time of fixation.

Example 5 Delivery of Synthetic RNA to the Skin

The complexation reaction shown in Table 5 was prepared using RNA encoding green fluorescent protein (GFP) or collagen, type VII, alpha1 (COL7), synthesized according to Example 1. The concentration of the RNA stock solution was 500 μg/mL.

TABLE 5

RNA Complexation Reaction

| | Volume |
|---|---|
| RNA solution tube | |
| GFP or COL7 RNA | 8 μL |
| FactorPlex ™ complexation buffer | 42 μL |
| Transfection reagent solution tube | |
| LIPOFECTAMINE 3000 (LIFE TECHNOLOGIES) | 4 μL |
| FactorPlex ™ complexation buffer | 46 μL |

Each tube was mixed by pipetting, and the transfection reagent solution tube was incubated for 30 s at room temperature. The transfection reagent solution was then transferred to the RNA solution, and the contents were mixed by rapidly pipetting up and down 10 times. Following a 10 min incubation, dilutions were prepared according to

TABLE 6

Injection Solutions

| Site | RNA | Complexation Volume | FactorPlex ™ Volume | RNA amount |
|---|---|---|---|---|
| 1 | GFP | 7.5 μL | 22.5 μL | 0.3 μg |
| 2 | GFP | 15 μL | 15 μL | 0.6 μg |
| 3 | GFP | 30 μL | 0 μL | 1.2 μg |
| 4 | COL7 | 30 μL | 0 μL | 1.2 μg |

For each injection, the corresponding solution was drawn into a 3 cc insulin syringe with an 8 mm, 31 gauge needle (Becton, Dickinson and Company, Part Number: 328291) and air bubbles were removed. A clear field was selected on the left forearm of a healthy 33 year-old male human subject, and was disinfected with 70% isopropanol and allowed to dry. The needle was positioned at an angle of approximately 10° to the anterior (palmar) forearm with bevel facing up, and was inserted until the bevel was just covered. 30 μL of the RNA solution was injected intradermally over the course of approximately 10 sec. A distinct wheal appeared during the injection process. The needle was withdrawn, the wheal remained for approximately 1 minute, and no fluid escaped from the injection site. A total of 4 injections were performed according to Table 6, and all of the injections were performed between 11 and 28 minutes following the preparation of the RNA complexation reaction. No swelling, redness, or soreness occurred as a result of the injections. A small amount of bleeding occurred when the needle was removed from sites 2 and 4, resulting in the appearance of a small red spot at these sites.

The injection sites were imaged according to the schedule of Table 7, and every 24 hours thereafter for 6 days. Fluorescence images were acquired using an inverted microscope (Nikon Eclipse TS100) equipped with an EXFO X-Cite™ 120 fluorescence illumination system and the filter sets shown in Table 7. Fluorescence images were captured using a Sony NEX-7 digital camera (FIGS. 9-12).

TABLE 7

Measurement Parameters

| Site | Time | Image Type | Exposure Time |
|---|---|---|---|
| All | 0 h | Brightfield | Automatic |
| 1 | 0 h | FITC | 1/10 s |
| 2 | 0 h | FITC | 1/10 s |
| 3 | 0 h | FITC | 1/10 s |
| 4 | 0 h | FITC | 1/10 s |
| 1 | 12 h | FITC | 1/10 s |
| 2 | 12 h | FITC | 1/10 s |
| 3 | 12 h | FITC | 1/10 s |
| 4 | 12 h | FITC | 1/10 s |
| 1 | 12 h | FITC | 1/20 s |
| 2 | 12 h | FITC | 1/20 s |
| 3 | 12 h | FITC | 1/20 s |
| 4 | 12 h | FITC | 1/20 s |
| All | 24 h | Brightfield | Automatic |
| 1 | 24 h | FITC | 1/20 s |
| 2 | 24 h | FITC | 1/20 s |
| 3 | 24 h | FITC | 1/20 s |
| 4 | 24 h | FITC | 1/20 s |
| 1 | 24 h | Cy3.5 | 1/5 s |
| 2 | 24 h | Cy3.5 | 1/5 s |
| 3 | 24 h | Cy3.5 | 1/5 s |
| 4 | 24 h | Cy3.5 | 1/5 s |
| 1 | 24 h | Cy3 | 1/5 s |
| 2 | 24 h | Cy3 | 1/5 s |
| 3 | 24 h | Cy3 | 1/5 s |
| 4 | 24 h | Cy3 | 1/5 s |
| 1 | 36 h | FITC | 1/20 s |
| 2 | 36 h | FITC | 1/20 s |
| 3 | 36 h | FITC | 1/20 s |
| 4 | 36 h | FITC | 1/20 s |
| 1 | 48 h | FITC | 1/20 s |
| 2 | 48 h | FITC | 1/20 s |
| 3 | 48 h | FITC | 1/20 s |
| 4 | 48 h | FITC | 1/20 s |

Figure 12:
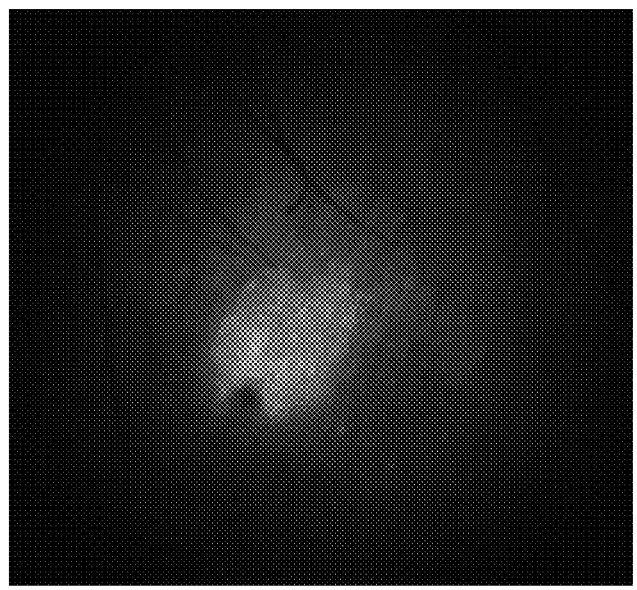
FIG. 12 depicts the results of fluorescent imaging of an independent experiment in which a region of the ventral forearm of as the subject shown in FIG. 6 treated with RNA comprising 5-methoxyuridine and encoding GFP. The image was taken 24 hours after injection.

An independent experiment was carried out using the 1.2 µg dose of GFP RNA, with similar results (FIG. 12).

TABLE 8

Filter Sets

| Image Type | Filter Set |
|---|---|
| Cy3 | Chroma SP102V2 |
| Cy3.5 | Chroma SP103V2 |
| FITC | Chroma SP101 |

Example 6 Transfection of Human Keratinocytes with RNA Encoding NOVEPOETIN

Figure 5:
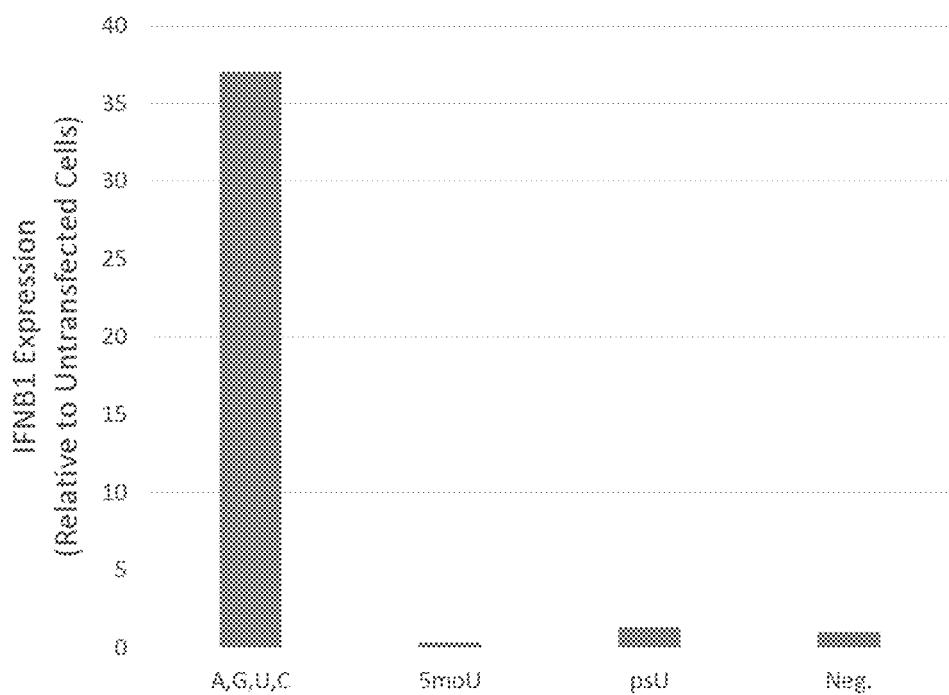
Figure 6:
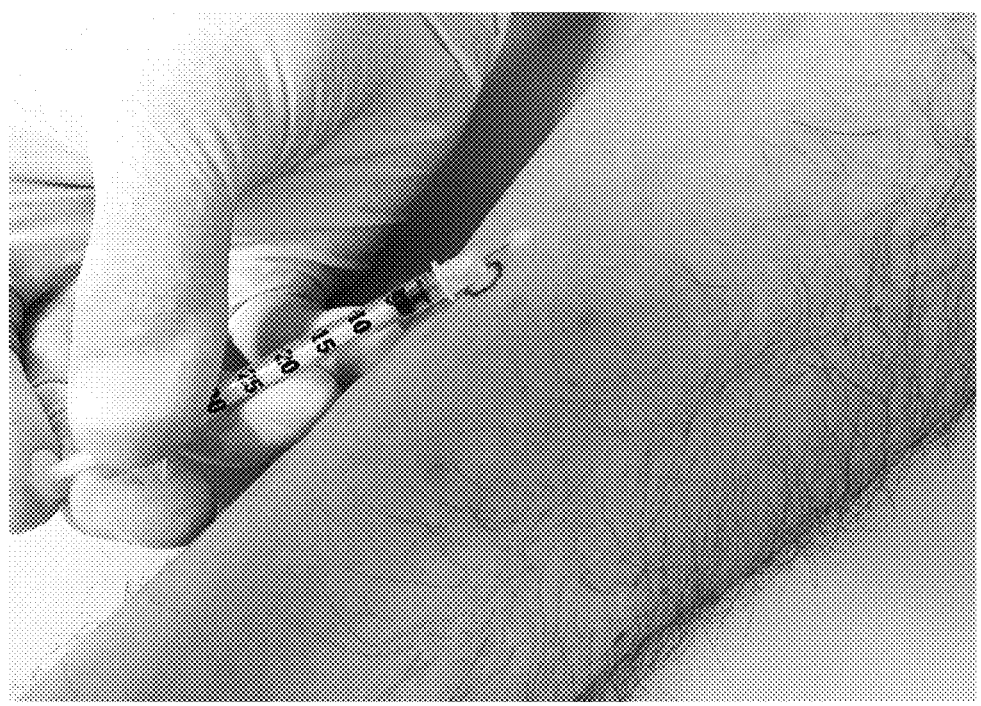
Figure 7:
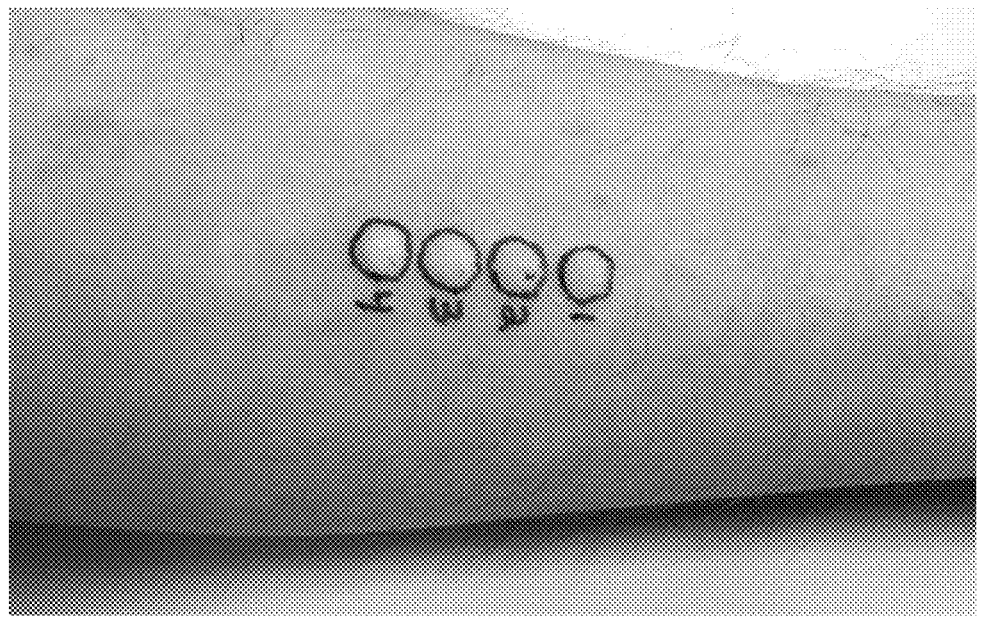
Figure 8:
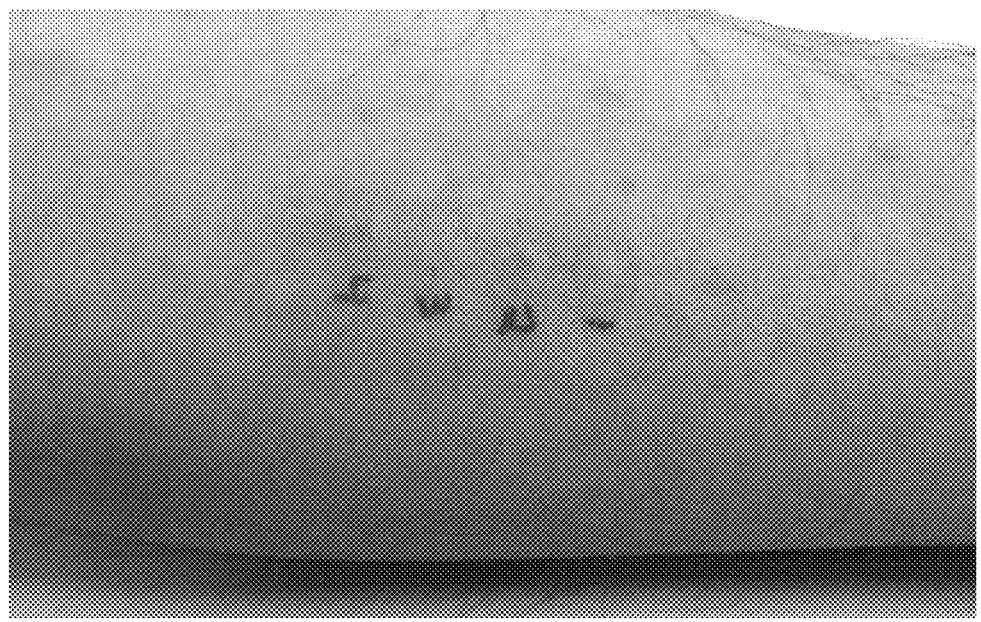
Figure 9:
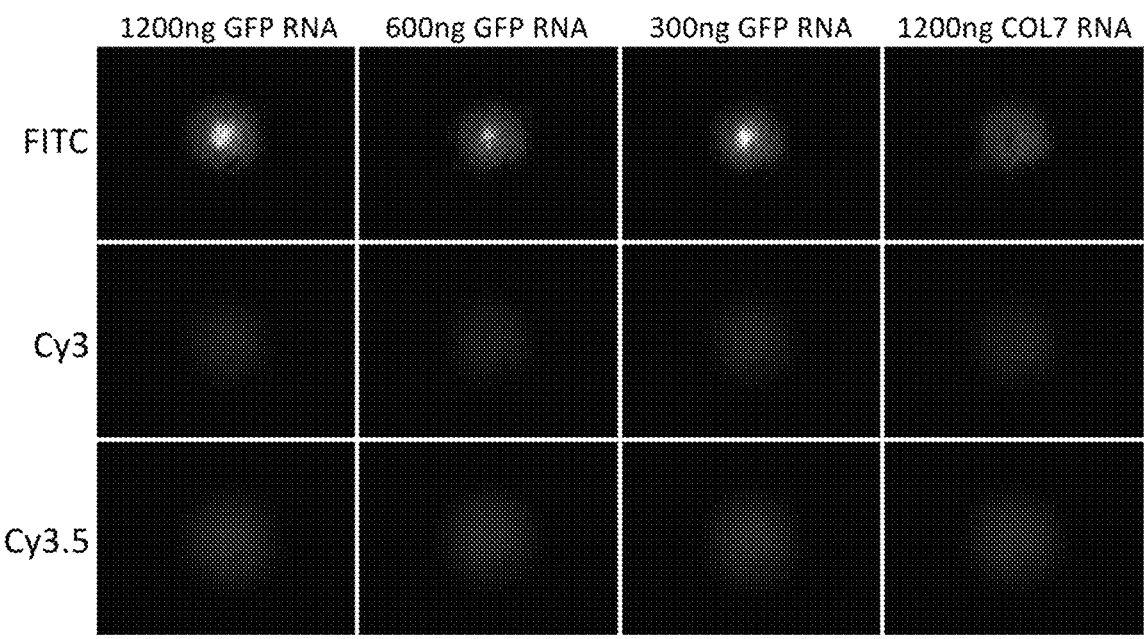
Figure 10:
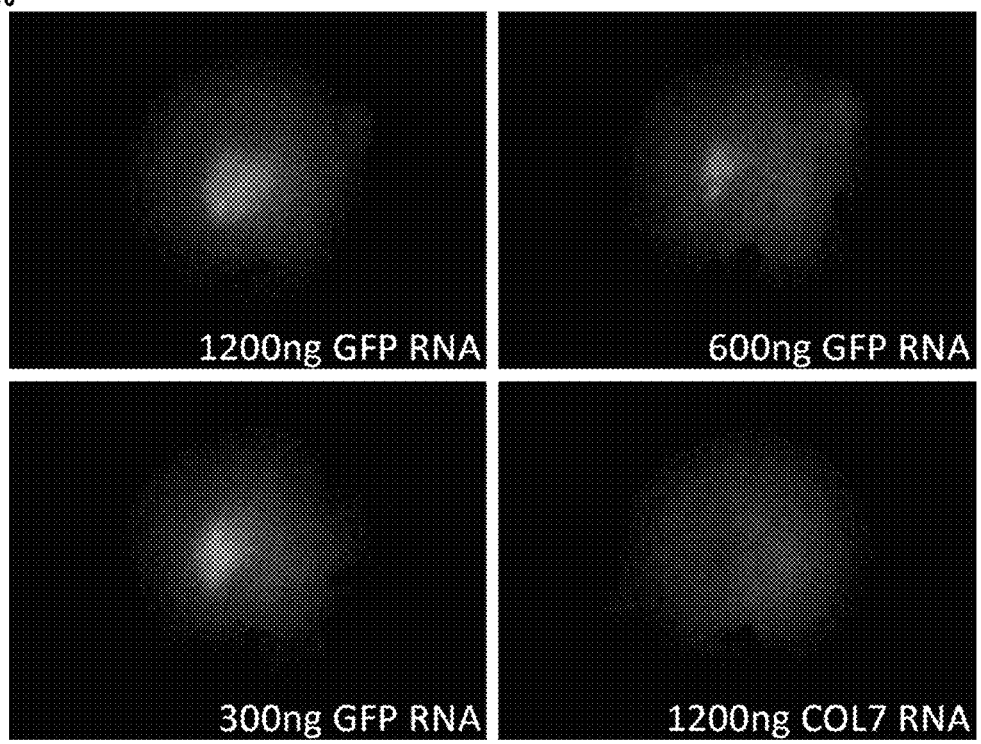

RNA encoding NOVEPOETIN was synthesized according to Example 1 with three nucleotide combinations: 1) U, G, U, C, 2) U, G, 5moU, C, and 3) U, G, psU, C. Sub-confluent layers of primary human keratinocytes cultured in EpiLife medium were transfected in wells of a 6 well plate according to Example 3 with 1 µg of RNA per well. 12, 24, 36 and 48 h following transfection, 0.5 mL of medium was removed and 0.5 mL of fresh EpiLife medium was added to the plate. After the final medium sampling, the cells were harvested by trypsinization, and total RNA was isolated using the RNeasy mini kit (Qiagen). Genomic DNA was digested using DNase I and RNA was purified. Expression of interferon-β and GAPDH was measured by RT-PCR (FIG. 5).

Example 7 Transfection of Human Cells with RNA Encoding hTERT

Figure 16:
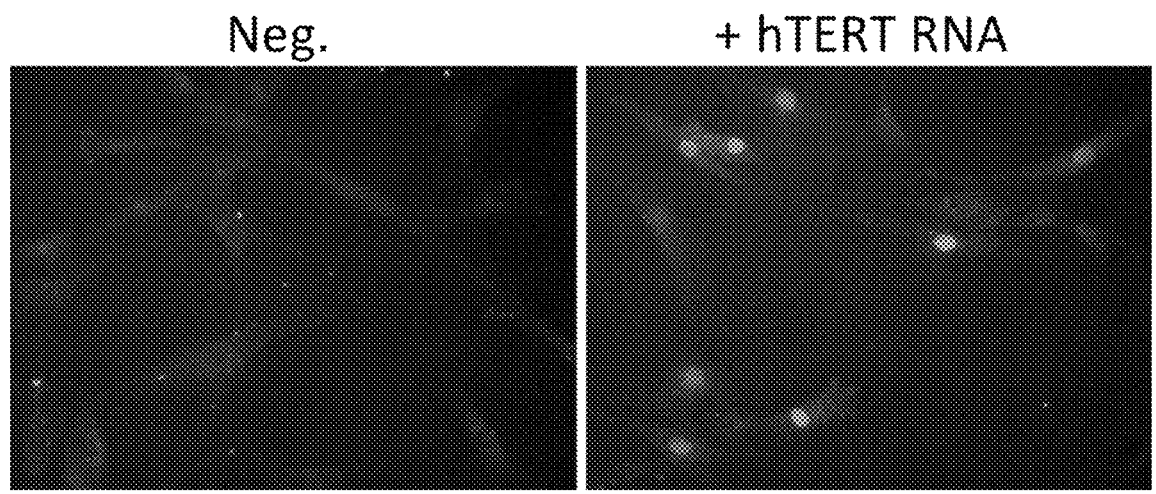
FIG. 16 depicts primary human dermal fibroblasts transfected with RNA comprising 5-methoxyuridine and encoding hTERT. Cells were fixed and stained using an antibody targeting hTERT 24 hours after transfection.

RNA encoding human telomerase reverse transcriptase (hTERT) was synthesized according to Example 1 with the following nucleotides: U, G, 5moU, C. A sub-confluent layer of primary human dermal fibroblasts cultured in DMEM+10% FBS were transfected in wells of a 24 well plate according to Example 3 with 0.25 µg of RNA per well. 12 h after transfection, cells were fixed and stained using a 1:50 dilution of rabbit anti-hTERT antibody (Millipore, Part Number: MABE14) (FIG. 16).

Example 8 High-Efficiency Gene Editing by Repeated Transfection with RIBOSLICE

Primary human fibroblasts were plated in 6-well plates coated with recombinant human fibronectin and recombinant human vitronectin (each diluted in DMEM/F12 to a concentration of 1 µg/mL, 1 mL/well, and incubated at room temperature for 1 h) at a density of 10,000 cells/well in transfection medium. The following day, the cells were transfected as in Example 2 with RNA synthesized according to Example 1. The following day cells in one of the wells were transfected a second time. Two days after the second transfection, the efficiency of gene editing was measured using a mutation-specific nuclease assay.

Example 9 Transfection of Cells with Synthetic RNA Containing Non-Canonical Nucleotides and DNA Encoding a Repair Template For transfection in 6-well plates, 1 µg RNA encoding gene-editing proteins targeting exon 16 of the human APP gene, 1 µg single-stranded repair template DNA containing a PstI restriction site that was not present in the target cells, and 6 µL transfection reagent (LIPOFECTAMINE RNAiMAX, Life Technologies Corporation) were first diluted separately in complexation medium (Opti-MEM, Life Technologies Corporation) to a total volume of 120 µL. Diluted RNA, repair template, and transfection reagent were then mixed and incubated for 15 min at room temperature, according to the transfection reagent-manufacturer's instructions. Complexes were added to cells in culture. Approximately 120 µL of complexes were added to each well of a 6-well plate, which already contained 2 mL of transfection medium per well. Plates were shaken gently to distribute the complexes throughout the well. Cells were incubated with complexes for 4 hours to overnight, before replacing the medium with fresh transfection medium (2 mL/well). The next day, the medium was changed to DMEM+10% FBS. Two days after transfection, genomic DNA was isolated and purified. A region within the APP gene was amplified by PCR, and the amplified product was digested with PstI and analyzed by gel electrophoresis.

Example 10 In Vivo RIBOSLICE Safety Study 40 female NCr nu/nu mice were injected subcutaneously with $5 \times 10^6$ MDA-MB-231 tumor cells in 50% Matrigel (BD Biosciences). Cell injection volume was 0.2 mL/mouse. The age of the mice at the start of the study was 8 to 12 weeks. A pair match was conducted, and animals were divided into 4 groups of 10 animals each when the tumors reached an average size of 100-150 mm³, and treatment was begun. Body weight was measured every day for the first 5 days, and then biweekly to the end of the study. Treatment consisted of RIBOSLICE BIRC5-1.2 complexed with a vehicle (LIPOFECTAMINE 2000, Life Technologies Corporation). To prepare the dosing solution for each group, 308 µL of complexation buffer (Opti-MEM, Life Technologies Corporation) was pipetted into each of two sterile, RNase-free 1.5 mL tubes. 22 µL of RIBOSLICE BIRC5-1.2 (500 ng/µL) was added to one of the two tubes, and the contents of the tube were mixed by pipetting. 22 µL of vehicle was added to the second tube. The contents of the second tube were mixed, and then transferred to the first tube, and mixed with the contents of the first tube by pipetting to form complexes. Complexes were incubated at room temperature for 10 min. During the incubation, syringes were loaded. Animals were injected either intravenously or intratumorally with a total dose of 1 µg RNA/animal in 60 µL total volume/animal. A total of 5 treatments were given, with injections performed every other day. Doses were not adjusted for body weight. Animals were followed for 17 days. No significant reduction in mean body weight was observed, demonstrating the in vivo safety of RIBOSLICE gene-editing RNA.

Example 11 Screening of Reagents for Delivery of Nucleic Acids to Cells

Delivery reagents including polyethyleneimine (PEI), various commercial lipid-based transfection reagents, a peptide-based transfection reagent (N-TER, Sigma-Aldrich Co. LLC.), and several lipid-based and sterol-based delivery reagents were screened for transfection efficiency and toxicity in vitro. Delivery reagents were complexed with RIBOSLICE BIRC5-1.2, and complexes were delivered to HeLa cells in culture. Toxicity was assessed by analyzing cell density 24 h after transfection. Transfection efficiency was assessed by analyzing morphological changes. The tested reagents exhibited a wide range of toxicities and transfection efficiencies. Reagents containing a higher proportion of ester bonds exhibited lower toxicities than reagents containing a lower proportion of ester bonds or no ester bonds.

Example 12 High-Concentration Liposomal RIBOSLICE

High-Concentration Liposomal RIBOSLICE was prepared by mixing 1 µg RNA at 500 ng/µL with 3 µL of complexation medium (Opti-MEM, Life Technologies Corporation), and 2.5 µL of transfection reagent (LIPOFECTAMINE 2000, Life Technologies Corporation) per µg of RNA with 2.5 µL of complexation medium. Diluted RNA and transfection reagent were then mixed and incubated for 10 min at room temperature to form High-Concentration Liposomal RIBOSLICE. Alternatively, a transfection reagent containing DOSPA or DOSPER is used.

Example 13 In Vivo RIBOSLICE Efficacy Study—Subcutaneous Glioma Model 40 female NCr nu/nu mice were injected subcutaneously with $1 \times 10^7$ U-251 tumor cells. Cell injection volume was 0.2 mL/mouse. The age of the mice at the start of the study was 8 to 12 weeks. A pair match was conducted, and animals were divided into 4 groups of 10 animals each when the tumors reached an average size of 35-50 mm$^3$, and treatment was begun. Body weight was measured every day for the first 5 days, and then biweekly to the end of the study. Caliper measurements were made biweekly, and tumor size was calculated. Treatment consisted of RIBOSLICE BIRC5-2.1 complexed with a vehicle (LIPOFECTAMINE 2000, Life Technologies Corporation). To prepare the dosing solution, 294 µL of complexation buffer (Opti-MEM, Life Technologies Corporation) was pipetted into a tube containing 196 µL of RIBOSLICE BIRC5-1.2 (500 ng/µL), and the contents of the tube were mixed by pipetting. 245 µL of complexation buffer was pipetted into a tube containing 245 µL of vehicle. The contents of the second tube were mixed, and then transferred to the first tube, and mixed with the contents of the first tube by pipetting to form complexes. Complexes were incubated at room temperature for 10 min. During the incubation, syringes were loaded. Animals were injected intratumorally with a total dose of either 2 µg or 5 µg RNA/animal in either 20 µL or 50 µL total volume/animal. A total of 5 treatments were given, with injections performed every other day. Doses were not adjusted for body weight. Animals were followed for 25 days.

Example 14 Liposome Formulation and Nucleic-Acid Encapsulation

Liposomes are prepared using the following formulation: 3.2 mg/mL N-(carbonyl-ethoxypolyethylene glycol 2000)-1,2-distearoyl-sn-glycero-3-phosphoethanolamine (MPEG2000-DSPE), 9.6 mg/mL fully hydrogenated phosphatidylcholine, 3.2 mg/mL cholesterol, 2 mg/mL ammonium sulfate, and histidine as a buffer. pH is controlled using sodium hydroxide and isotonicity is maintained using sucrose. To form liposomes, lipids are mixed in an organic solvent, dried, hydrated with agitation, and sized by extrusion through a polycarbonate filter with a mean pore size of 800 nm. Nucleic acids are encapsulated by combining 10 µg of the liposome formulation per 1 µg of nucleic acid and incubating at room temperature for 5 minutes.

Example 15 Folate-Targeted Liposome Formulation

Liposomes are prepared using the following formulation: 3.2 mg/mL N-(carbonyl-ethoxypolyethylene glycol 2000)-1,2-distearoyl-sn-glycero-3-phosphoethanolamine (MPEG2000-DSPE), 9.6 mg/mL fully hydrogenated phosphatidylcholine, 3.2 mg/mL cholesterol, 2 mg/mL ammonium sulfate, and histidine as a buffer, with 0.27 mg/mL 1,2-distearoyl-sn-glycero-3-phosphoethanolamine-N-[folate(polyethylene glycol)-5000] (FA-MPEG5000-DSPE) added to the lipid mixture. pH is controlled using sodium hydroxide and isotonicity is maintained using sucrose. To form liposomes, lipids are mixed in an organic solvent, dried, hydrated with agitation, and sized by extrusion through a polycarbonate filter with a mean pore size of 800 nm. Nucleic acids are encapsulated by combining 10 µg of the liposome formulation per 1 µg of nucleic acid and incubating at room temperature for 5 minutes.

Example 16 Therapy Comprising Liposomal Protein-Encoding RNA

Liposomes encapsulating synthetic RNA encoding a therapeutic protein, synthesized according to Example 1, are prepared according to Example 14 or Example 15. The liposomes are administered by injection or intravenous infusion.

Example 17 Generation of Elastin ivT-RNA Template

Total RNA was extracted from neonatal human dermal fibroblasts using the RNeasy mini kit (QIAGEN GmbH), according to the manufacturer's instructions. cDNA encoding human elastin was prepared using MonsterScript™ Reverse Transcriptase (Epicentre Biotechnologies) and the primer: AAAAAAACCGGT TCATTTTCTCTTCCGGC-CAC (SEQ ID NO:483). An in vitro transcription (ivT) template was prepared from the cDNA by PCR amplification of the elastin coding sequence (CDS) using the primers: F: AAAAAAGCTAGCATGGCGGGTCTGACG (SEQ ID NO:484), and R: AAAAAAACCGGTTCAT-TTTCTCTTCCGGCCAC (SEQ ID NO:485). The PCR product was then purified using agarose gel electrophoresis and the QIAquick Gel Extraction Kit (QIAGEN GmbH) and was cloned into a vector containing the human beta globin (HBB) 5' and 3' untranslated regions and a strong Kozak sequence. The vector was amplified, purified, and linearized prior to RNA synthesis.

Example 18 Generation of Tyrosinase ivT-RNA Template

Total RNA was extracted from human epidermal melanocytes using the RNeasy mini kit (QIAGEN GmbH), according to the manufacturer's instructions. cDNA encoding human tyrosinase was prepared using MonsterScript™ Reverse Transcriptase (Epicentre Biotechnologies). An in vitro transcription (ivT) template was prepared from the cDNA by PCR amplification of the tyrosinase coding sequence (CDS). The PCR product was then purified using agarose gel electrophoresis and the QIAquick Gel Extraction Kit (QIAGEN GmbH) and was cloned into a vector containing the human beta globin (HBB) 5' and 3' untranslated regions and a strong Kozak sequence. The vector was amplified, purified, and linearized prior to RNA synthesis.

Example 19 Synthesis of Tyrosinase RNA

RNA encoding human tyrosinase was synthesized according to Example 1, using the DNA template of Example 18 and the T7 High Yield RNA Synthesis Kit (New England Biolabs, Inc.), according to the manufacturer's instructions (Table 4). Samples of the RNA were analyzed by agarose gel electrophoresis to assess the quality of the RNA. The RNA was then diluted to 1 µg/µL. The RNA solution was stored at 4 C.

Example 20 Increasing Melanin Production in Skin by Transdermal Injection Via Syringe of RNA Encoding Tyrosinase The RNA of Example 19 was loaded into a syringe and delivered to the dermis of the ventral forearm of a healthy 33 year-old male patient over the course of approximately 30 seconds.

Example 21 Increasing Melanin Production in Skin by Combined Delivery of RNA Encoding Tyrosinase and Electroporation The area of skin treated in Example 20 was exposed to electrical pulses of between 10V and 155V and between approximately 10 milliseconds and approximately 1 second using a two-electrode array electrically connected to a capacitor. The patient reported a tingling sensation at all voltages and penetration depths. The treated area became darker after 24-48 hours. The experiment was repeated several times, with similar results.

Example 22 Increasing Melanin Production in Skin by Topical or Intradermal Application of RNA Encoding Tyrosinase The RNA of Example 19 or the liposomes of Example 16 are applied directly to the skin, with or without disruption of the stratum corneum or injected intradermally using a dose of one microgram or less per square centimeter. Optionally, an electric field is applied as in Example 21 or using a surface-contact patch to enhance delivery of the RNA.

Example 23 Increasing Elastin Production in Skin by Transdermal Delivery of RNA Encoding Elastin RNA encoding elastin was prepared according to Example 1. The RNA is delivered as in Example 20, 21, or 22.

Example 24 Increasing Collagen Production in Skin by Transdermal Delivery of RNA Encoding Collagen RNA encoding collagen was prepared according to Example 1. The RNA is delivered as in Example 20, 21, or 22.

Example 25 Anemia Therapy Comprising Delivery of RNA Encoding NOVEPOETIN

RNA encoding NOVEPOETIN was prepared according to Example 1. The RNA is delivered as in Example 20, 21, or 22.

Example 26 Increasing Production of Actin in Skeletal Muscle by Intramuscular Delivery of RNA Encoding Actin RNA encoding actin is prepared according to Example 1. The RNA is delivered to the patient via intramuscular injection with or without the use of an electric field as in Example 20, 21, or 22.

Example 27 Wound Healing Treatment

RNA encoding basic fibroblast growth factor is prepared according to Example 1. The RNA is delivered as in Example 20, 21, or 22.

Example 28 Anti-Scarring Treatment

RNA encoding collagenase is prepared according to Example 1. The RNA is delivered as in Example 20, 21, or 22.

Example 29 Production of Botulinum Toxin

RNA encoding botulinum toxin is prepared according to Example 1. The RNA is delivered as in Example 20, 21, or 22.

Example 30 Increasing Collagen Production in Skin Cells by Transfection with RNA Encoding Collagen I RNA comprising the coding sequence of the human COL1A1 gene was synthesized according to Example 1. Primary human dermal fibroblasts were plated in wells of a 24-well plate, and were transfected according to Example 2. Between 24 and 72 hours after transfection, the cells were fixed and stained using an antibody targeting collagen I. Many extracellular deposits of collagen were visible in the transfected wells.

Example 31 Increasing Collagen Production in Skin Cells by Transfection with RNA Encoding Collagen VII RNA comprising the coding sequence of the human COL7 gene was synthesized according to Example 1. Primary human dermal fibroblasts were plated in wells of a 24-well plate, and were transfected according to Example 2. Between 24 and 72 hours after transfection, the cells were fixed and stained using an antibody targeting collagen VII. Transfected cells exhibited high levels of collagen VII, compared to an un-transfected control.

Example 32 Increasing Collagen Production in Skin by Transdermal Injection Via Syringe of RNA Encoding Collagen I or Collagen VII RNA comprising the coding sequence of the human COL1A1 gene or the human COL7 gene was synthesized according to Example 1. The RNA is loaded into a syringe and delivered to the dermis of a patient over the course of approximately 30 seconds or as in Example 20, 21, or 22.

Example 33 Increasing Collagen Production in Skin by Combined Delivery of RNA Encoding Collagen I or Collagen VII and Electroporation The area of skin treated in Example 32 is exposed to electrical pulses of between 10V and 155V and between approximately 50 microseconds and approximately 1 second using a multi-electrode array electrically connected to a power source.

Example 34 Storage and Stability of Synthetic RNA Complexes

Figure 17:
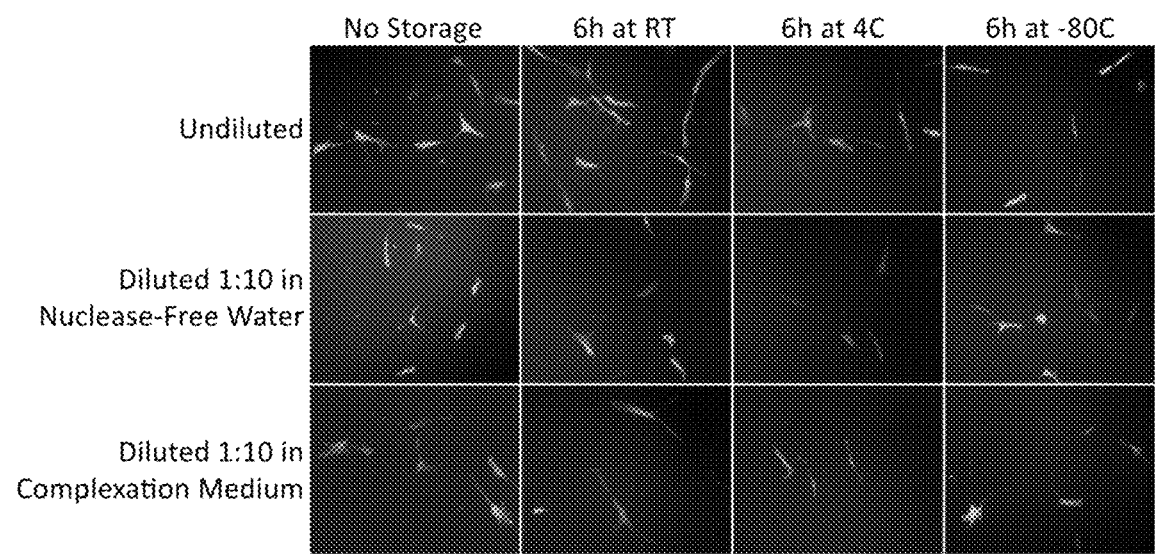
FIG. 17 depicts primary adult human dermal fibroblasts transfected with RNA encoding green fluorescent protein ("GFP"), prepared and stored as indicated.

A complexation reaction using RNA encoding GFP was prepared according to Example 5. Following the 10 min incubation, the complexation reaction was divided into three equal parts, one of which was diluted 1:10 in FactorPlex™ complexation medium, one of which was diluted 1:10 in sterile, nuclease-free water, and one of which was left undiluted. Each of the three parts was then further divided into four equal parts, one of which was applied to primary human dermal fibroblasts according to Example 3, one of which was left at room temperature for six hours before applying to primary human dermal fibroblasts according to Example 3, one of which was placed at 4° C. for six hours before applying to primary human dermal fibroblasts according to Example 3, and one of which was snap frozen in liquid nitrogen and placed at −80° C. for six hours before applying to primary human dermal fibroblasts according to Example 3. The cells were imaged using a fluorescence microscope approximately 24 hours after the first transfection (FIG. 17). All wells contained GFP-positive cells, demonstrating that the synthetic RNA complexes were stable and maintained activity in all of the storage conditions tested.

Example 35: In Vivo Analysis of NOVECRIT

RNA encoding NOVEPOETIN was synthesized according to Example 1 with the nucleotide combination A, G, 5moU, C. In this Example, NOVECRIT was formulated with a lipid delivery vehicle, specifically LIPOFECTAMINE 3000. In this Example, NOVECRIT encoded NOVEPOETIN, a novel, high-stability erythropoiesis-stimulating agent.

A 15-day maximum tolerated dose (MTD) study was performed to evaluate safety (rat, n=62). In vivo toxicology and biodistribution, as well as pharmacodynamics and dose response and therapeutic effect, specifically on erythropoiesis, were evaluated. Furthermore, the immune response was monitored by analysis of cytokines in treated animals.

Sixty-nine, naïve, 8 week old male Sprague-Dawley rats (*Rattus norvegicus*) weighing 253 to 274 grams at receipt were used (HARLAN LABORATORIES). Animals were acclimated to the study room for at least seven days prior to dosing. On Day −2 all animals were shaved in the dorsal lumbar area and four intradermal sites (upper left, upper right, lower right and lower left) were designated on the dorsal back using a permanent marker. Sixty-four animals were randomly assigned to four treatment groups, with the remaining five animals serving as spares. Two animals were dropped from the study because of incomplete dosing.

The following study design was used (total dose volumes (μL) were constant):

| Group | Dose Level (μg) | Dose Route | Conc. (μg/mL) | Dose Vol. (μL) | Number of Males |
|---|---|---|---|---|---|
| 1 | 0 | Intradermal | 0 | 50 | $4^a + 2^b + 2^h$ |
| 2 | 0.25 | Intradermal | 5.0 | 50 | $4^a + 2^b + 2^c + 2^d + 2^e + 2^f + 2^g + 2^h$ |
| 3 | 1.0 | Intradermal | 20 | 50 | $4^a + 2^b + 2^c + 2^d + 2^e + 2^f + 2^g + 2^h$ |
| 4 | 4 × 1.0 μg (4.0 μg total) | Intradermal | 20 | 50 | $4^a + 2^b + 3^c + 3^d + 2^e + 2^f + 2^g + 2^h$ |

ID: $^a$Toxicology animals necropsy on Day 15, TK animals with terminal tissue collections on Days 6 ($^b$) and 24 ($^c$) hours postdose, and on Days 3 ($^d$), 4 ($^e$), 6 ($^f$), 8 ($^g$), and 15 ($^h$)

Blood was collected from the vena cava from anesthetized animals prior to necropsy or terminal tissue collection. Whenever possible, blood was collected via a single draw and then divided appropriately. Blood specimens for toxicokinetic analysis were collected from two animals per time point for Group 1 at 6 hours postdose and on Day 15. For Groups 2-4, blood specimens were collected at 6 and 24 hours postdose, and on Days 3, 4, 6, 8, and 15.

Blood specimens for hematology assessment were collected from all toxicology animals on Day 15 following an overnight fast, and all TK animals scheduled for terminal tissue collections at 6 and 24 hours postdose and on Days 8 and 15. Whole blood (1.3 mL) was deposited into K2EDTA tubes and analyzed using an Advia 120 automated analyzer.

Blood specimens for coagulation assessment were collected from all toxicology animals on Day 15 following an overnight fast. Coagulation specimens (1.8 mL) were collected into 3.2% sodium citrate tubes, processed according to standard procedures and analyzed using a STA Compact automated analyzer.

Blood specimens for serum chemistry assessments were collected from all toxicology animals on Day 15 following an overnight fast. Serum chemistry specimens (1 mL) were collected into serum separator tubes, processed according to standard procedures and analyzed using an AU680 analyzer.

Blood specimens for cytokine analysis were collected from animals scheduled for terminal tissue collection at 5 and 24 hours postdose and Day 8. Cytokine specimens (1 mL) were collected into K2EDTA tubes and processed to plasma according to standard procedures. TNFα, IL-6, and IFNα cytokine levels in plasma samples were studied. The study measured the production of TNFα, IL-6, and IFNα cytokines in plasma samples following dosing with the test article on Day 1 (6 hours post-dose), Day 2 (24 hours post-dose) and Day 8.

Study Outline for Cytokine Analysis Samples:

| Group | NOVECRIT Dose Level (μg) | Dose Concentration (μg/mL) | Dose Volume (μL) | Number of Rats (Males) | Endpoints |
|---|---|---|---|---|---|
| 1 | 0 | 0 | 50 | $2^b$ | Plasma TNFα, IL-6, and IFNα cytokine analysis |
| 2 | 0.25 | 5.0 | 50 | $2^b + 2^c + 2^g$ | |
| 3 | 1.0 | 20 | 50 | $2^b + 2^c + 2^g$ | |
| 4 | 4 × 1.0 μg (4.0 μg total) | 20 | 50 | $2^b + 2^c + 2^g$ | |

$^b$= plasma samples collected 6 hours post-dose,
$^c$= plasma samples collected 24 hours post-dose,
$^g$= plasma samples collected 8 days post-dose.

For TNFα analysis, plasma samples were analyzed using a commercially-available assay kit from R&D SYSTEMS (cat. no. RTA00). The rat TNFα ELISA is a solid phase enzyme-linked immunosorbent assay. The ELISA kit employs a TNFα-specific anti-rat monoclonal antibody for solid phase immobilization (pre-coated on the microtiter plate), and HRP conjugated to an anti-rat TNFα polyclonal antibody for detection. The reference standard provided with the kit is a recombinant rat TNFα. For each assay, plasma samples and standards were diluted with the diluent provided in each respective kit. For the TNFα ELISA, plasma samples were diluted 1:2. The standard curve consisted of six (6) serial 2-fold concentrations ranging from 800 to 12.5 μg/mL. Controls were reconstituted with diluent, and blanks contained diluent only.

Following sample, standard, control, or diluent addition (50 μL per well, each in duplicate), plates were incubated for 2 hours at room temperature. Following a wash step to remove unbound substances, HRP conjugate was added to each well (100 μL/well), and plates were incubated for 2 hours at room temperature. Following a second wash step, 100 μL/well TMB substrate was added to the plate. The plate was incubated for 30 minutes at room temperature, protected from light, to allow the color reaction to develop. The reaction was stopped following the addition of HCl Stop Solution (100 μL/well). The optical density was read on a SpectraMax 340 (MOLECULAR DEVICES) plate reader at 450 nm, within 30 minutes following addition of Stop Solution. The intensity of the color measured was in proportion to the amount of rat TNFα bound in the initial step. A standard curve was generated for each assay plate, and test sample TNFα concentrations were determined by interpolation of absorbance A450 values from the standard curve and dilution factor. The assay range for the TNFα kit is 12.5-800 pg/mL, with a minimum detectable concentration of less than 10 pg/mL (with the 1:2 minimum required dilution for plasma samples).

For IL-6 analysis, plasma IL-6 samples were analyzed using a commercially-available assay kit from R&D SYSTEMS (cat. no. R6000B-IL-6). The rat IL-6 ELISA is a solid phase enzyme-linked immunosorbent assay. The ELISA kit employs anti-rat IL-6 monoclonal antibody for solid phase immobilization (pre-coated on the microtiter plate), and HRP conjugated to IL-6-specific anti-rat polyclonal antibody for detection. The reference standard provided with the kit is a recombinant rat IL-6. Plasma samples were used undiluted (as provided), and standards were diluted with the diluent provided in the kit. The standard curve consisted of six (6) serial 2-fold concentrations ranging from 4,000 to 62.5 pg/mL. Controls were reconstituted with diluent, and blanks contained diluent only. Following sample, standard, control, or diluent addition (50 μL per well, each in duplicate), plates were incubated for 2 hours at room temperature. Following a wash step to remove unbound substances, HRP conjugate was added to each well (100 μL/well), and plates were incubated for 2 hours at room temperature. Following a second wash step, 100 μL/well TMB substrate was added to the plate. The plate was incubated for 30 minutes at room temperature, protected from light, to allow the color reaction to develop. The reaction was stopped following the addition of HCl Stop Solution (100 μL/well). The optical density was read on a SpectraMax 340 (MOLECULAR DEVICES) plate reader at 450 nm, within 30 minutes following addition of Stop Solution. The intensity of the color measured was in proportion to the amount of rat IL-6 bound in the initial step. A standard curve was generated for each assay plate, and test sample IL-6 concentrations were determined by interpolation of absorbance A450 values from the standard curve and dilution factor. The assay range for the IL-6 kit is 62.5-4,000 pg/mL, with a minimum detectable concentration of less than 21 pg/mL.

For IFNα analysis, plasma IFNα samples were analyzed using a commercially-available assay kit from NOVATEINBIO (cat. no. BG-RAT11380). The ELISA is a solid phase enzyme-linked immunosorbent assay. The ELISA kit employs anti-rat IFNα monoclonal antibody for solid phase immobilization (pre-coated on the microtiter plate), and HRP conjugated antibody specific for IFNα for detection. Plasma samples were diluted 1:4, and the standards were used as provided in the kit. Standards consisted of six (6) serial 2-fold concentrations ranging from 100 to 3.1 pg/mL. Blanks contained diluent only. Following sample, standard, or diluent addition (50 μL per well, each in duplicate), HRP conjugate was added to each well (100 μL/well), and plates were incubated for 1 hours at 37° C. Following a wash step, 50 μL/well each of Chromogen Solution A and Chromogen Solution B were added to the plate. The plate was incubated for 15 minutes at 37° C., protected from light, to allow the color reaction to develop.

The reaction was stopped following the addition of Stop Solution (50 μL/well). The optical density was read on a SpectraMax 340 (MOLECULAR DEVICES) plate reader at 450 nm. The intensity of the color measured was in proportion to the amount of rat IFNα bound in the initial step. A standard curve was generated for each assay plate, and test IFNα concentrations were determined by interpolation of absorbance A450 values from the standard curve and dilution factor. The assay range for the IFNα kit is 3.1-100 pg/mL, with a minimum detectable concentration of less than 1 pg/mL (4 pg/mL, with the 1:4 dilution required for plasma samples).

Figure 18:
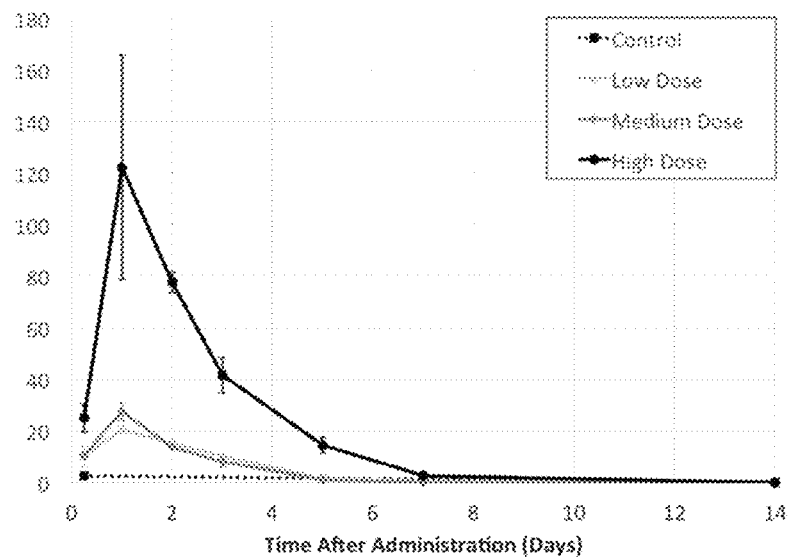
FIG. 18 depicts single administration of NOVECRIT induced a rapid increase and sustained level of NOVEPOIETIN in serum. The Y axis shows concentration of NOVEPOIETIN protein (mU/mL).

The results of this study were, inter alia, that NOVECRIT was not detected at the injection site 24 h after dosing (as assayed by RT-PCR). More specifically, NOVECRIT was not detected in any of the following samples (RT-PCR): serum (6 h, 24 h, 48 h and 72 h after dosing), liver (6 h and 24 h after dosing), and kidney (6 h and 24 h after dosing). Further, positive controls (spiked with NOVECRIT) yielded a robust signal in all tissues (as assayed RT-PCR). FIG. 18 depicts single administration of NOVECRIT induced a rapid increase and sustained level of NOVEPOIETIN in serum. The Y axis shows concentration of NOVEPOIETIN protein (mU/mL). This suggests, without wishing to be bound by theory, that the studied RNA therapeutic is able to provide therapeutically important pharmacodynamic properties. In fact, this PD behavior is vastly improved relative to wild type EPO (which is known in the art to have a half-life of about 4-12 hours).

Furthermore, serum spiked with NOVECRIT showed near-instant degradation of the RNA (as assayed by RT-PCR). Without wishing to be bound by theory, this data indicates that the present RNA therapeutics are safe and have little chance of toxicity limitations, for example, liver or kidney toxicities.

Figure 19:
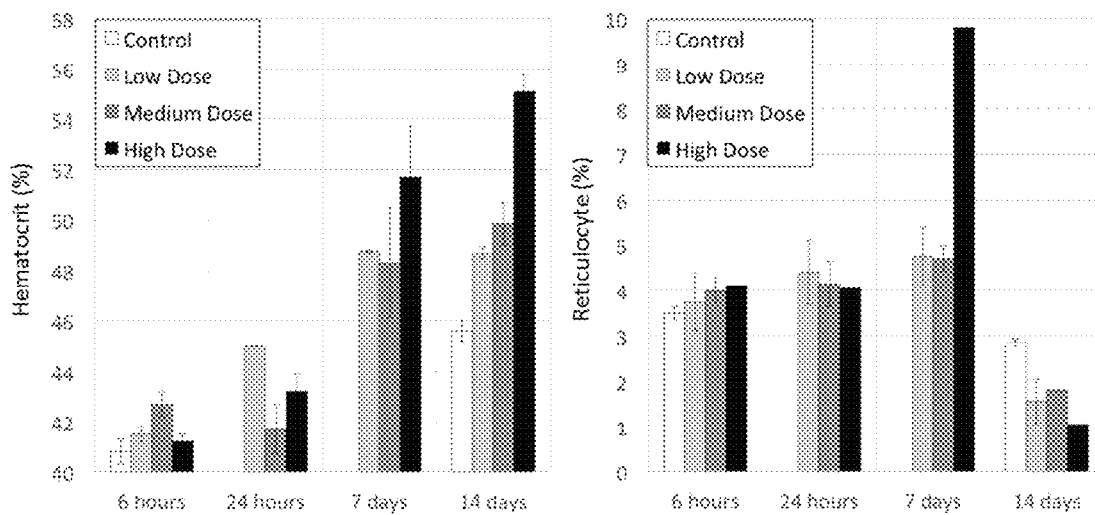
FIG. 19 depicts a single administration of NOVECRIT stimulated erythropoiesis, yielding elevated hematocrit for at least 14 days. The left panel shows % hematocrit on the Y axis, while the right panel shows % reticulocytes.

FIG. 19 depicts a single administration of NOVECRIT stimulated erythropoiesis, yielding elevated hematocrit for at least 14 days. The left panel shows % hematocrit on the Y axis, while the right panel shows % reticulocytes. Accordingly, the studied RNA therapeutic is fully functional.

With respect to cytokines, IL-6 and TNFα cytokine levels were below assay detection thresholds for all animals at each of the timepoints evaluated in this study. Low levels of IFN-Ⅲ were only detectable in the Day 8 samples from animals in Groups 3 and 4. FIG. 20 depicts a table summarizing TNFα, IL-6, and IFNα cytokine levels in plasma samples collected from a maximum tolerated dose of NOVECRIT in male Sprague Dawley rats. Without wishing to be bound by theory, this data indicates that the present RNA therapeutics do not stimulate an unfavorable immunogenicity which has limited the therapeutic utility of certain RNA therapeutics.

Example 36: Gene Editing of the COL7A Gene

Figure 21:
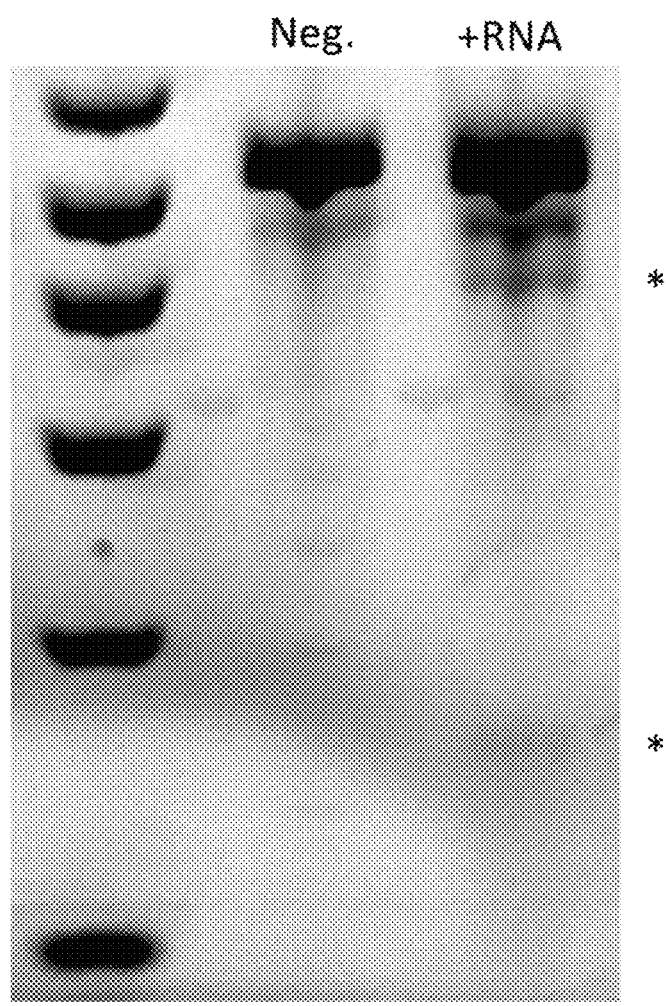
FIG. 21 depicts a SURVEYOR assay using the DNA of primary adult human dermal fibroblasts transfected with RNA TALENs targeting the sequence TGAGCAGAAGTGGCTCAGTG (SEQ ID NO:467) and TGGCTGTACAGCTACACCCC (SEQ ID NO: 468), located within the COL7A1 gene. The bands present in the +RNA lane indicate editing of a region of the gene that is frequently involved in dystrophic epidermolysis bullosa.
Figure 22:
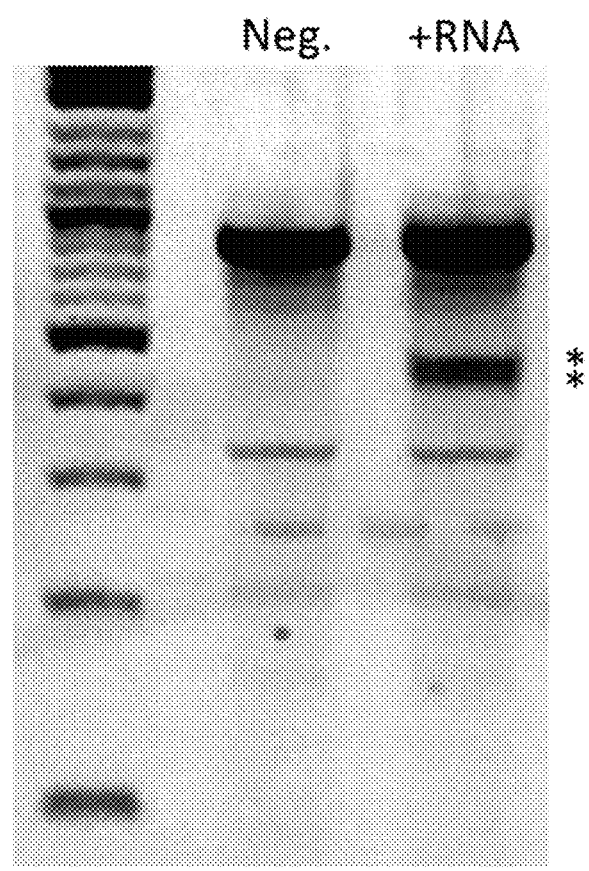
FIG. 22 depicts a SURVEYOR assay using the DNA of primary adult human dermal fibroblasts transfected with RNA TALENs targeting the sequence TTCCACTCCTGCAGGGCCCC (SEQ ID NO:469) and TCGCCCTTCAGCCCGCGTTC (SEQ ID NO:470), located within the COL7A1 gene. The bands present in the +RNA lane indicate editing of a region of the gene that is frequently involved in dystrophic epidermolysis bullosa.

The present RNA-based gene editing approaches were applied to the COL7A1 gene. This gene is of interest because, inter alia, it is frequently involved in dystrophic epidermolysis bullosa. FIG. 21 depicts a SURVEYOR assay using the DNA of primary adult human dermal fibroblasts transfected with RNA TALENs targeting the sequence TGAGCAGAAGTGGCTCAGTG (SEQ ID NO:467) and TGGCTGTACAGCTACACCCC (SEQ ID NO:468), located within the COL7A1 gene. The bands present in the +RNA lane indicate editing of a region of the gene that is frequently involved in dystrophic epidermolysis bullosa. FIG. 22 depicts another SURVEYOR assay using the DNA of primary adult human dermal fibroblasts transfected with RNA TALENs, now targeting the sequence TTC-CACTCCTGCAGGGCCCC (SEQ ID NO:469) and TCGCCCTTCAGCCCGCGTTC (SEQ ID NO:470), located within the COL7A1 gene. The bands present in the +RNA lane indicate editing of a region of the gene that is frequently involved in dystrophic epidermolysis bullosa. This data points to, among others, a gene editing approach to the treatment of certain genetic disorders such as dystrophic epidermolysis bullosa.

Example 37: Gene-Editing of the MYC Gene Using a Synthetic RNA with Non-Canonical Nucleotides Experiments were conducted with in vitro transcribed synthetic RNA molecules containing non-canonical nucleotides and encoding gene-editing proteins. The immunogenicity and the gene-editing efficiency of in vitro transcribed synthetic RNA molecules having (1) only pseudouridine (psU) as a non-canonical nucleotide; (2) only 5-methylcytidine (5mC) as a non-canonical nucleotide; and (3) both of pseudouridine and 5-methylcytidine as non-canonical nucleotides was evaluated (as well as controls).

Figure 23:
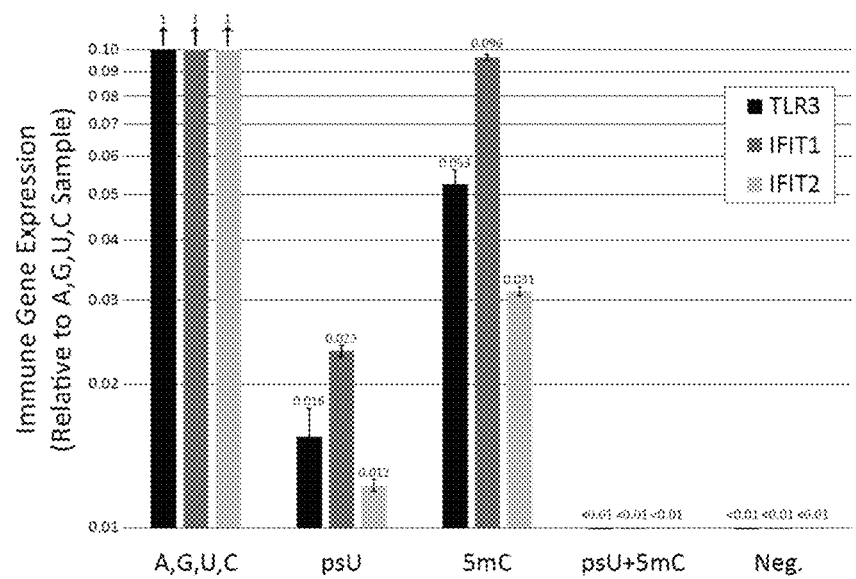
FIG. 23 shows the immunogenicity of various synthetic RNA constructs in the context of a gene-editing (i.e. unmodified nucleotides "A,G,U,C"; pseudouridine only "psU"; 5-methylcytidine only "5mC"; both pseudouridine and 5-methylcytidine "psU+5mC"; and a negative control "neg").

Specifically, mRNA containing the following nucleotide combinations: (i) A,G,U,C, (ii) A,G,psU,C, (iii) A,G,U,5mC, and (iv) A,G,psU,5mC, and encoding TALEN pairs targeting the following DNA sequences, which can be found within the MYC gene: TCGGCCGCCGCCAAGCTCGT (SEQ ID NO:474) and TGCGCGCAGCCTGGTAGGAG (SEQ ID NO:475), were synthesized according to the methods described herein. Human dermal fibroblasts (MA001SK) were plated in 6-well and 24-well tissue culture plates in DMEM with 10% FBS at 100,000 and 10,000 cells per well, respectively. The next day, the cells were transfected in the 6-well plate with 2 μg of RNA (1 μg for each component of the TALEN pair) and the cells were transfected in the 24-well plate with 0.2 μg of RNA (0.1 μg for each component of the TALEN pair) according to the methods described herein. 24 hours after transfection, the total RNA from the cells in the 24-well culture plate was isolated using an RNeasy Mini Kit (74106; QIAGEN), including isolating the total RNA from a sample of cells that had not been transfected with RNA (negative control; "Neg." in FIG. 23). The genomic DNA was removed by a 15 minute digestion with DNase I (RNase-Free) (M0303L; NEW ENGLAND BIOLABS) and the reaction purified using an RNeasy Mini Kit. 1 μL of total RNA was used to assess gene expression by real-time RT-PCR using TAQMAN gene-expression assays (APPLIED BIOSYSTEMS) designed to detect expression of the immunogenicity markers TLR3, IFIT1, and IFIT2 (FIG. 23). The data were normalized to both the positive experimental control sample ("A,G,U,C") and to a loading control (GAPDH).

Figure 24:
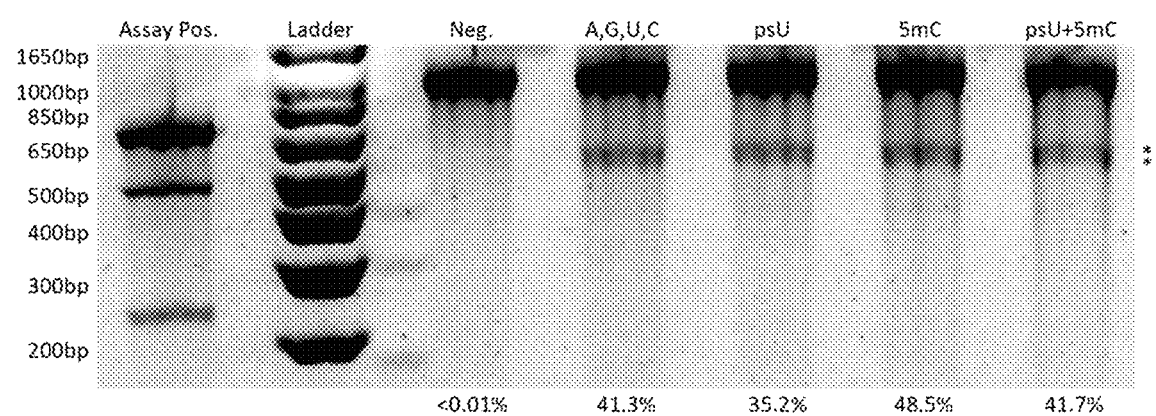
FIG. 24 shows the gene-editing activity in cells transfected with various synthetic RNA constructs (i.e. unmodified nucleotides "A,G,U,C"; psuedouridine only "psU"; 5-methylcytidine only "5mC"; both psuedouridine and 5-methylcytidine "psU+5mC"; and a negative control "neg").

48 hours after transfection, the genomic DNA was isolated from the cells in the 6-well culture plate using a DNeasy Blood and Tissue Kit (69506; QIAGEN), including from a sample of cells that had not been transfected with RNA (negative control, "Neg." in FIG. 24). A 970 bp region of the MYC gene surrounding the predicted TALEN cut location was amplified using a 35 cycle 2-step PCR reaction containing the following primers: TAACTCAA-GACTGCCTCCCGCTTT (SEQ ID NO: 476) and AGCC-CAAGGTTTCAGAGGTGATGA (SEQ ID NO: 477). 160 ng was hybridized in 5 μL of amplified sequence from RNA-treated cells to 160 ng in 5 μL of amplified sequences from untreated MA001SK cells by mixing the two sequences with 0.5 µL of 1M KCl and 0.5 µL of 25 mM MgCl₂ and running the following program in a thermocycler: 95° C. for 10 minutes; 95° C. to 85° C. at 0.625 C/s; 85° C. to 25° C. at 0.125 C/s. The SURVEYOR assay was performed by adding 0.5 µL of SURVEYOR nuclease and 0.5 µL of Enhancer from the SURVEYOR Mutation Detection Kit (7060201; INTEGRATED DNA TECHNOLOGIES) to the hybridized product, mixing, and incubating at 42° C. for 25 minutes. The protocol above was also used to process the positive control DNA sample provided with the SURVEYOR Mutation Detection Kit as a positive experimental control for the SURVEYOR Assay ("Assay Pos." in FIG. 24). Samples were analyzed by agarose gel electrophoresis (FIG. 24). For each sample, gene-editing efficiency was calculated as a ratio of the intensity of the digested bands (indicated by "*" in FIG. 24) to that of the undigested band.

As shown in FIG. 23 below, the samples from cells transfected with the positive control RNA (A,G,U,C), and the samples from cells transfected with RNA containing either pseudouridine or 5-methylcytidine exhibited upregulation of all three of the immunogenicity markers TLR3, IFIT1, and IFIT2. The sample from cells transfected with RNA containing both pseudouridine and 5-methylcytidine exhibited negligible upregulation of the immunogenicity markers (less than 0.01-fold of the positive control), demonstrating that in vitro transcribed synthetic RNA with both pseudouridine and 5-methylcytidine and encoding a gene-editing protein can evade detection by the innate-immune system of mammalian cells.

Further, as shown in FIG. 24 below, the sample from cells transfected with RNA containing both pseudouridine and 5-methylcytidine exhibited highly efficient gene editing (41.7%), which was greater than the efficiency exhibited by samples from cells transfected with RNA containing pseudouridine alone (35.2%), demonstrating that in vitro transcribed synthetic RNA comprising both pseudouridine and 5-methylcytidine and encoding a gene-editing protein can both (i) gene-edit mammalian cells at high efficiency, and (ii) gene-edit mammalian cells at higher efficiency than in vitro transcribed synthetic RNA comprising pseudouridine and not comprising 5-methylcytidine.

Example 38: COL7A1 Gene Editing and Repair in Human Cells

RNA encoding gene editing proteins targeting the following sequences in the COL7A1 gene was synthesized according to Example 1: TGAGCAGAAGTGGCTCAGTG (SEQ ID NO:473) and TGGCTGTACAGCTACACCCC (SEQ ID NO:468) (see also table below).

| RNA Synthesis | | | |
| --- | --- | --- | --- |
| Template | Nucleotides | Reaction Volume/µL | ivT Yield/µg |
| COL7A1 TALEN 1L | A, G, 5moU, C | 20 | 120.528 |
| COL7A1 TALEN 1R | A, G, 5moU, C | 20 | 120.204 |
| COL7A1 TALEN 1L | A, G, 5moU, C | 15 | 81.94 |
| COL7A1 TALEN 1R | A, G, 5moU, C | 15 | 61.88 |

Figure 25:
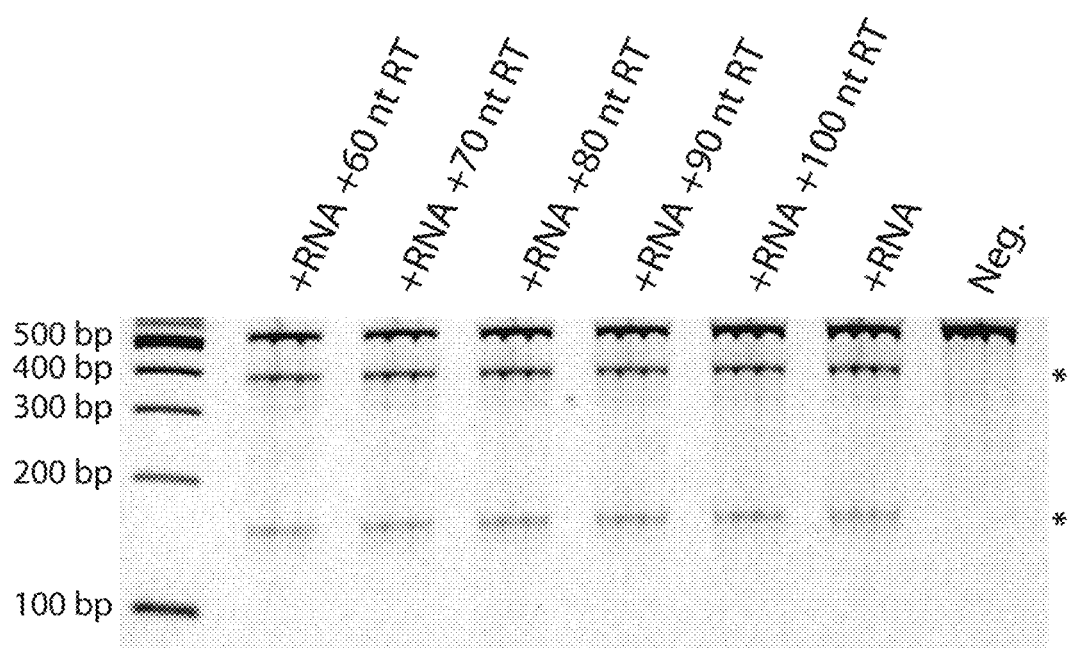
FIG. 25 depicts gene editing of the COL7A1 gene in primary human epidermal keratinocytes transfected with RNA encoding TALENs and a single-stranded DNA repair template ("RT") of the indicated length. The presence of bands at the locations shown by asterisks ("*") indicates successful gene editing.
Figure 27:
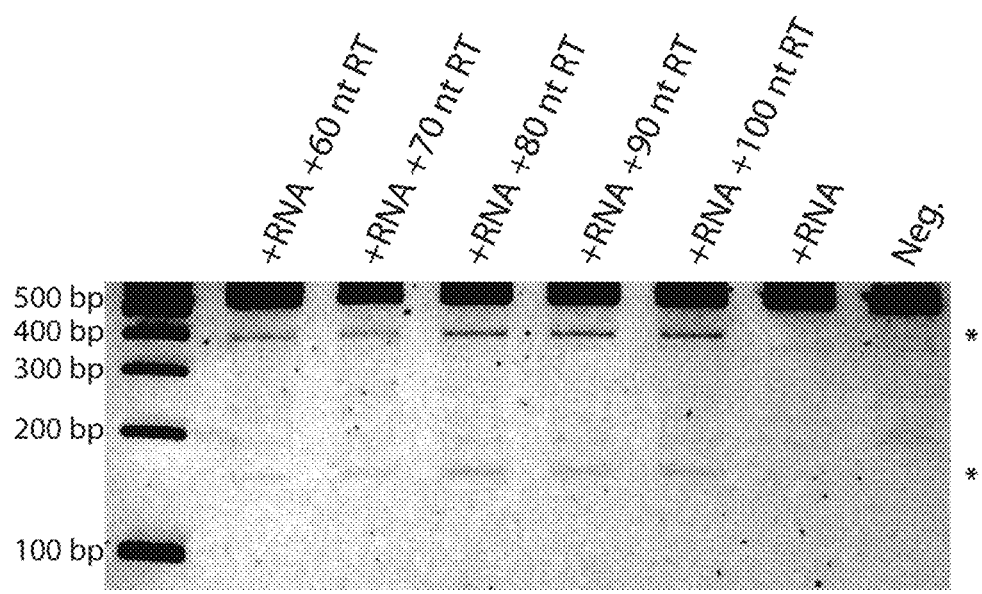
FIG. 27 depicts gene correction of the COL7A1 gene in primary human epidermal keratinocytes transfected with RNA encoding TALENs and a single-stranded DNA repair template ("RT") of the indicated length. The presence of bands at the locations shown by asterisks ("*") indicates successful gene correction.
Figure 29:
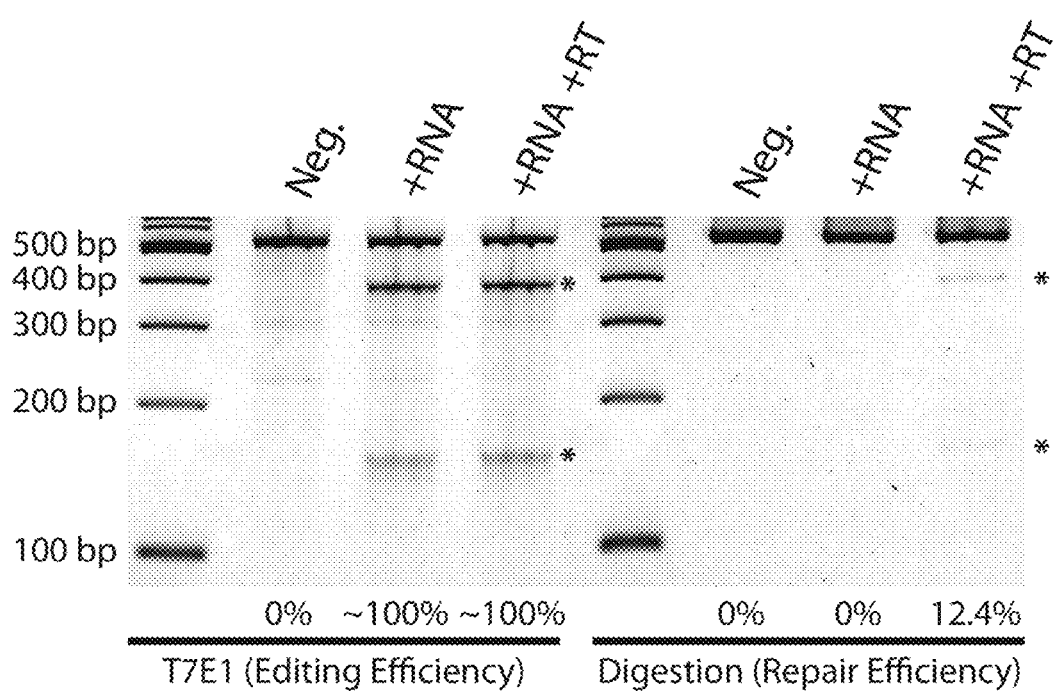
FIG. 29 depicts gene editing ("T7E1") and correction ("Digestion") of the COL7A1 gene in primary human epidermal keratinocytes transfected with RNA encoding TALENs and an 80 nt single-stranded DNA repair template ("RT"). The presence of bands at the locations shown by asterisks ("*") indicates successful gene editing ("T7E1") and correction ("Digestion").

50,000 primary human epidermal keratinocytes (HEKn, Gibco) were plated in wells of 6-well plates in EpiLife+Supplement S7. The next day, cells were transfected according to Example 3 with 1 µg of RNA encoding each component of the gene editing pair and 2 µg of a single-stranded DNA repair template having a length of 60, 70, 80, 90 or 100 nucleotides ("nt"). 48 hours after transfection, genomic DNA was purified. A segment of the COL7A1 gene was amplified using the primers GCATCTGCCCTGCGG-GAGATC (SEQ ID NO:478) and CCACGTTCTCC-TTTCTCTCCCCGTTC (SEQ ID NO:479), which produce a 535 bp amplicon. The efficiency of gene editing was assessed using T7 Endonuclease I ("T7E1", New England Biolabs) according to the manufacturer's instructions. Bands of approximately 385 bp and 150 bp indicate successful gene editing. FIG. 25 and FIG. 29 show the result of digestion with T7EI, analyzed by agarose gel electrophoresis. FIG. 27 and FIG. 29 show the result of digestion with MluI-HF, analyzed by agarose gel electrophoresis. Because the repair template contains the sequence ACGCGT (SEQ ID NO:480), digestion of the amplified product with MluI-HF (New England Biolabs) produces bands of approximately 385 bp and 150 bp in the case of successful gene repair.

Figure 26:
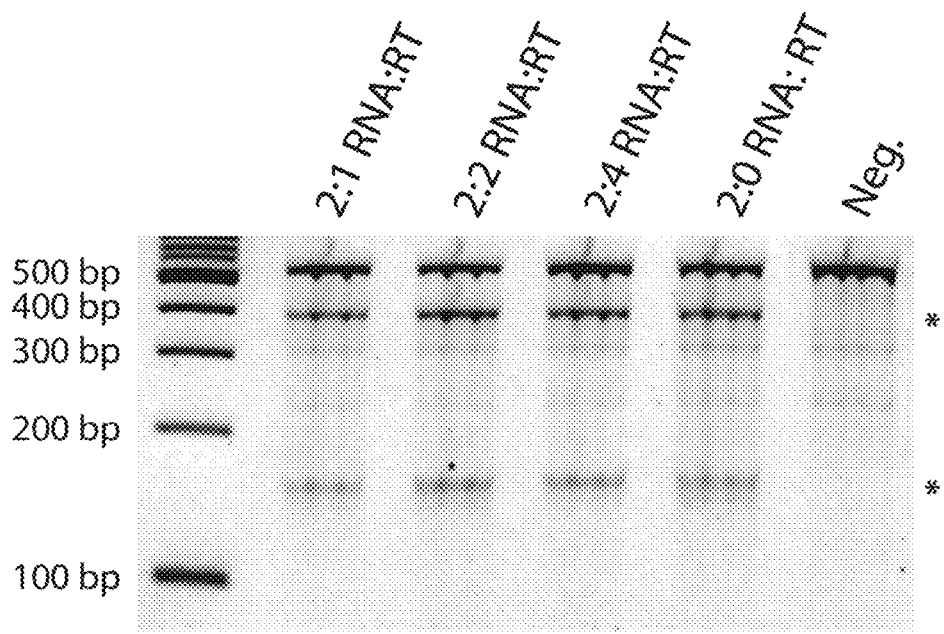
FIG. 26 depicts gene editing of the COL7A1 gene in primary human epidermal keratinocytes transfected with RNA encoding TALENs and an 80 nt single-stranded DNA repair template ("RT") at the indicated ratios of RNA to repair template. The presence of bands at the locations shown by asterisks ("*") indicates successful gene editing.
Figure 28:
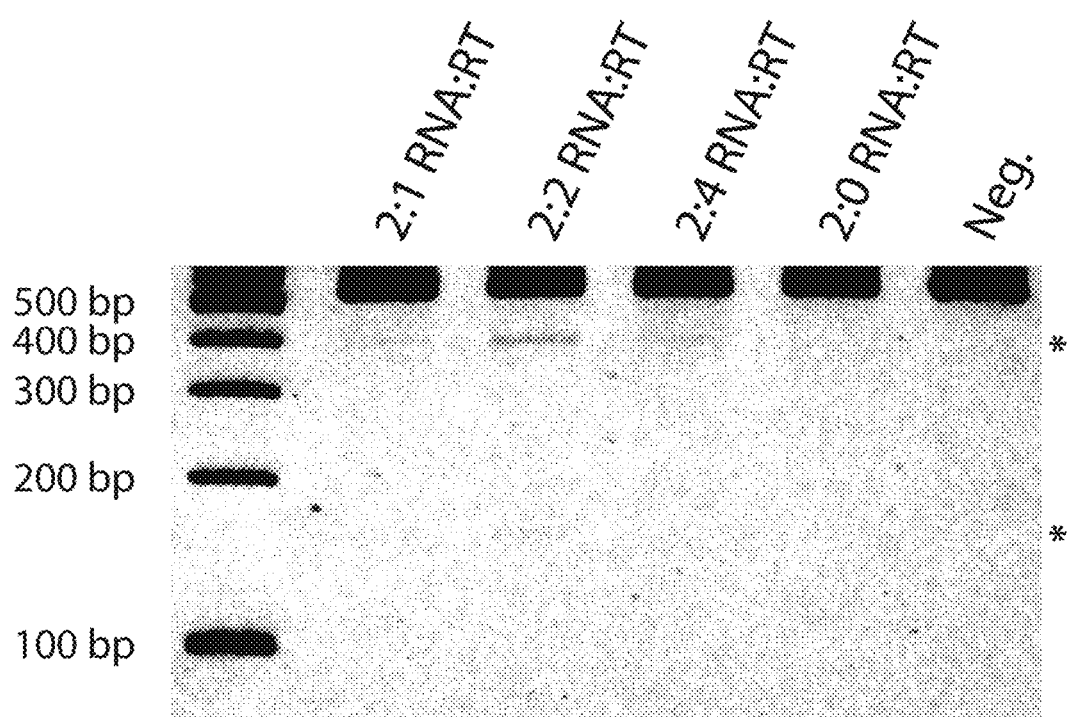
FIG. 28 depicts gene correction of the COL7A1 gene in primary human epidermal keratinocytes transfected with RNA encoding TALENs and an 80 nt single-stranded DNA repair template ("RT") at the indicated ratios of RNA to repair template. The presence of bands at the locations shown by asterisks ("*") indicates successful gene correction.

RNA encoding gene editing proteins targeting the following sequences in the COL7A1 gene was synthesized according to Example 1: TGAGCAGAAGTGGCTCAGTG (SEQ ID NO:473) and TGGCTGTACAGCTACACCCC (SEQ ID NO:468). 50,000 primary human epidermal keratinocytes (HEKn, Gibco) were plated in wells of 6-well plates in EpiLife+Supplement S7. The next day, cells were transfected according to Example 3 with 1 µg of RNA encoding each component of the gene editing pair and 1-4 µg of an 80 nucleotide single-stranded DNA repair template. 48 hours after transfection, genomic DNA was purified. A segment of the COL7A1 gene was amplified using the primers GCATCTGCCCTGCGGGAGATC (SEQ ID NO:481) and CCACGTTCTCCTTTCTCTCCCCGTTC (SEQ ID NO: 482), which produce a 535 bp amplicon. The efficiency of gene editing was assessed using T7 Endonuclease I ("T7E1", New England Biolabs) according to the manufacturer's instructions. Bands of approximately 385 bp and 150 bp indicate successful gene editing. FIG. 26 show the result of digestion with T7E1, analyzed by agarose gel electrophoresis. FIG. 28 show the result of digestion with MluI-HF, analyzed by agarose gel electrophoresis. Because the repair template contains the sequence ACGCGT (SEQ ID NO:480), digestion of the amplified product with MluI-HF (New England Biolabs) produces bands of approximately 385 bp and 150 bp in the case of successful gene repair.

Example 39: Expression of BMP7 Variants in Human Cells

RNA encoding wild type BMP7 and RNA encoding variants of BMP7 was synthesized according to Example 1 (see also table below).

| RNA Synthesis | | | |
| --- | --- | --- | --- |
| Template | Nucleotides | Reaction Volume/µL | ivT Yield/µg |
| BMP7 Wild Type | A, G, 5moU, C | 15 | 125.8 |
| BMP7 Variant A | A, G, 5moU, C | 15 | 120.36 |

-continued

RNA Synthesis

| Template | Nucleotides | Reaction Volume/μL | ivT Yield/μg |
|---|---|---|---|
| BMP7 Variant B | A, G, 5moU, C | 15 | 143.14 |
| BMP7 Variant C | A, G, 5moU, C | 15 | 106.42 |

Figure 30:
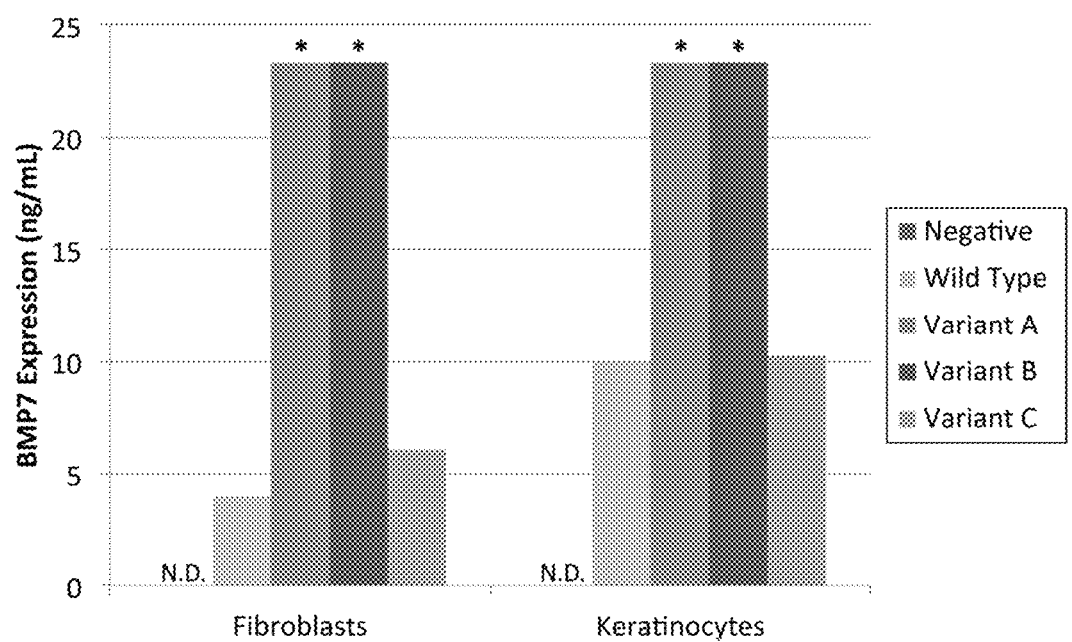
FIG. 30 depicts the amount of BMP7 protein secreted by primary human dermal fibroblasts and primary human epidermal keratinocytes transfected with RNA encoding the indicated BMP7 variant, measured by ELISA. Asterisks ("*") indicate saturation of the ELISA assay.

50,000 primary human dermal fibroblasts (MA001SK, Factor Bioscience) or 100,000 primary human epidermal keratinocytes (HEKn, Gibco) were plated in DMEM+10% FBS or EpiLife+Supplement S7, respectively. Cells were transfected according to Example 3 with 1 μg of RNA encoding wild type BMP7 or a variant thereof. 24 hours after transfection, the medium was sampled and secreted BMP7 levels were measured with a human BMP7 ELISA kit (ab99985, Abcam) using medium diluted 10-fold according to the manufacturer's instructions. Secreted BMP7 levels were determined by measuring 450 nm absorbance using a microplate reader (EMax Plus, Molecular Devices). Secreted BMP7 levels are shown in FIG. 30.

Example 40: Expression of Parathyroid Hormone (PTH) in Human Cells

RNA encoding PTH was synthesized according to Example 1 (see also table below).

RNA Synthesis

| Template | Nucleotides | Reaction Volume/μL | ivT Yield/μg |
|---|---|---|---|
| PTH | A, G, 5moU, C | 15 | 51.68 |

Figure 31:
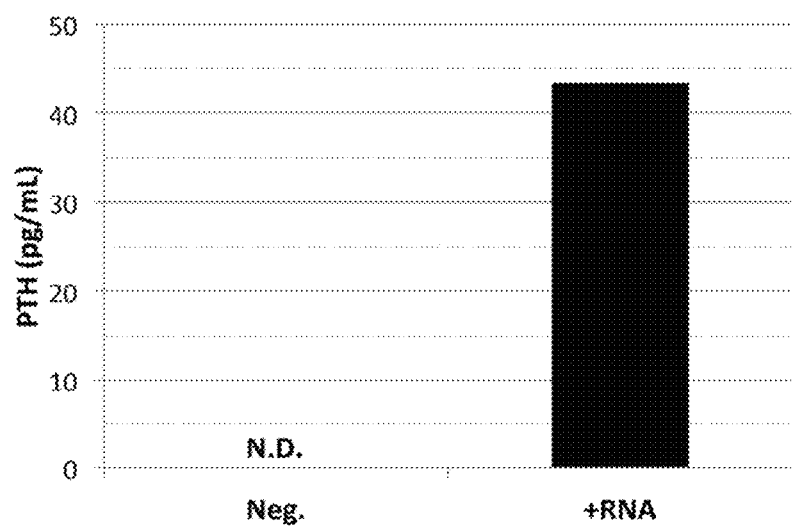
FIG. 31 depicts the amount of parathyroid hormone secreted by primary human epidermal keratinocytes transfected with RNA encoding PTH, measured by ELISA.

100,000 human epidermal keratinocytes (HEKn, Gibco) were plated in EpiLife+Supplement S7. Cells were transfected according to Example 3 with 1 μg of RNA encoding PTH. 24 hours after transfection, the medium was sampled and secreted PTH levels were measured using a human PTH ELISA kit (EIA-PTH-1, Ray Biotech) according the manufacturer's instructions. Secreted PTH levels were determined by measuring 450 nm absorbance using a microplate reader (EMax Plus, Molecular Devices). Secreted PTH levels are shown in FIG. 31.

Example 41: Intradermal, Subcutaneous, Rectal and Nasal Administration of NOVECRIT for the Treatment of Anemia A repeat dose toxicity study of Novecrit was conducted for the treatment of anemia. Specifically, 8-10 weeks old male Sprague Dawley rats were administered with Novecrit via intradermal, subcutaneous, rectal, or nasal routes once per day on days 1, 8, and 15. The animals were assigned to groups and treated as indicated in the table below:

| Group | Group Color | Test Article | Dose Route | Dose Level (μg) | Dose Concentration (μg/mL) | Dose Volume (μL) | Number of Animals Males |
|---|---|---|---|---|---|---|---|
| 1 | White | Control | Intradermal | 0.0 | 0.0 | 50 | $3^a + 8^b$ |
| 2 | Yellow | Novecrit | Intradermal | 4X (0.25 μg/injection; 1.0 μg total) | 5.0 | 50 | $3^a + 8^b$ |
| 3 | Green | Novecrit | Subcutaneous | 4.0 | 20.0 | 200 | $3^a + 8^b$ |
| 4 | Blue | Novecrit | Rectal | 4.0 | 20.0 | 200 | $3^a + 8^b$ |
| 5 | Red | Novecrit | Nasal | 4.0 | 20.0 | 200 | $3^a + 8^b$ |

Note:
Total dose volume (μL/per animal) are constant
[a]Toxicity animals (also called main study animals), necropsy on Day 44
[b]TK animals, euthanized as n = 2/time point on Days 2, 16, 23 and 44

More particularly, Group 1 was dosed via intradermal injection. Each dose was administered in four intradermal injections of 50 μL/injection for a total of 200 uL per animal. Injections were carried out on previously marked sites near the midline of the dorsal lumbar area (upper left, upper right, lower left and lower right quadrants). Group 2 was dosed four intradermal injections at 0.25 μg each (1.0 μg total) into previously marked sites near the midline of the dorsal lumbar area (upper left, upper right, lower left and lower right quadrants). Group 3 was dosed by subcutaneous injections into an area of the back located in the lower dorsal thoracic/lumbar region. Group 4 was dosed by rectal administration. The animal was manually restrained and the abdomen of each rat was manually palpated to remove any fecal matter. If deemed necessary, the rectum was lavaged with up to 2 ml of saline for enema followed by manual palpation of the abdomen to remove the fecal matter, if any. Novecrit was drawn into a syringe and an appropriately sized gavage needle with a rounded tip (ball) was attached to the syringe. A lubricant jelly was applied to the insertion device to aid with insertion; it was advanced approximately 1 cm into the lumen of the colon and the Novecrit instilled. The rat was then maintained in a head-down position for approximately 20-30 seconds to limit the expulsion of solution. Group 5 was dosed via nasal route. The animal was anesthetized (per SNBL USA SOP). The animal laid on its back with the head elevated. The dose was dispensed slowly into the nares. Approximately half the dose volume was administered to one nare. The remaining dose volume was administered to another nare. The first dose was administered on Day 1, and the last dose on Day 15.

The rats were clinically monitored including their food consumption and body weight. In addition, blood was collected for hematology, coagulation, and serum chemistry analysis as indicated below:

| Toxicity Group Specimen collection frequency | | | |
|---|---|---|---|
| Time Point | Hematology | Coagulation | Serum Chemistry |
| Day 44 | 1X (n = 3/Group) | 1X (n = 3/Group) | 1X (n = 3/Group) | x = Number of times procedure performed

Analysis was done on the toxicokinetic group as follows:

| In-text Table 3: Toxicokinetic Group Specimen collection frequency | | | |
|---|---|---|---|
| Time Point | Hematology[a] | TK | Cytokines |
| Acclimation | 1X (n = 8/Group) | — | — |
| Day 2 | — | 1X (n = 2/Group, 24 hours postdose) | 1X (n = 2/Group, 24 hours postdose) |
| Day 8 | Pre-dose (n = 6/Group) | — | — |
| Day 15 | Pre-dose (n = 6/Group) | — | — |
| Day 16 | — | 1X (n = 2/Group, 24 hours postdose) | 1X (n = 2/Group, 24 hours postdose) |
| Day 22 | 1X (n = 4/Group) | — | — |
| Day 23 | — | 1X (n = 2/Group) | 1X (n = 2/Group) |
| Day 29 | 1X (n = 2/Group) | — | — |
| Day 36 | 1X (n = 2/Group) | — | — |
| Day 43 | 1X (n = 2/Group) | — | — |
| Day 44 | — | 1X (n = 2/Group) | 1X (n = 2/Group) | x = Number of times procedure performed
TK = toxicokinetics

Terminal necropsy for toxicity animals occurred on Day 44. TK animals were euthanized on Days 2, 16, 23, and 44. Pathological analysis was conducted on the animals.

As shown in FIG. 32, administration of NOVECRIT stimulated erythropoiesis resulting in elevated hematocrit for at least 14 days in all four study groups compared to control.

Example 42: Intradermal Administration of RNA Encoding BMP7 Variants for the Treatment of Diabetic Nephropathy A ZDSD rat model was utilized to study the effects of RNAs encoding BMP7 variants for the prevention and treatment of diabetic nephropathy. Specifically, ZDSD rats were treated with RNAs encoding BMP7 variants administered intradermally. A schematic of the study design is provided in FIG. 33. The animals were assigned to groups and treated as indicated in the table below:

| Group Number | Treatment | No. of Animals | Dose Level (μg) | Dose Conc. (μg/ml) | Dose Volume (ml/kg) | Frequency | Route of Admin. |
|---|---|---|---|---|---|---|---|
| 1 | Vehicle | 24 | 0 | 0 | 0.1 | 2x/wk | I.D. |
| 2 | FTB-F1 (wt BMP7) | 6 | 1 | 5 | 0.1 | 2x/wk | I.D. |
| 3 | FTB-F2 (BMP7 variant A) | 6 | 1 | 5 | 0.1 | 2x/wk | I.D. |
| 4 | FTB-F3 (BMP7 variant B) | 6 | 1 | 5 | 0.1 | 2x/wk | I.D. |
| 5 | Lisinopril | 6 | Standard | Standard | 5 | Continuous | Diet |
| 6[a] | Vehicle | 20 | 0 | 0 | 0.2/rat | 3x/wk | I.D. |
| 7[a] | FTB-F2 (BMP7 variant A) | 10 | 2 | 10 | 0.2/rat | 3x/wk | I.D. |

[a] Group 1 animals at the end of the "Prevention" arm were randomized into Groups 6 and 7 (n = 20 or 10 each, respectively) to define the "Treatment" arm. The remaining 6 animals from Group 1 were euthanized for kidney collection and blood draw at the end of the "Prevention" arm.

To study the effect of the RNAs on prevention of diabetic nephropathy, animals were delivered from the barrier (PCO-5638) to the vivarium (PCO-Rm C) and allowed 3 days for acclimation. All animals were placed on 5SCA diabetogenic diet for 3 weeks (weekly body weight measurements were taken). Animals were then returned to regular 5008 diet for the duration of the study (weekly body weight measurements were taken). After 2 weeks on 5008 diet, body weight measurement, blood draw (500 ul) and a 24 hour baseline urine collection (urinary albumin and creatinine measurements) were performed on all animals. 36 rats were randomized to groups 1, 2 and 3 based on body weight, glucose and urinary albumin. Groups 1, 2, 3 and 4 received either vehicle or test article (i.d.) via intradermal administration (2x/week, Mon and Thur). Group 5 was administered Lisinopril admixed in the 5008 diet (food consumption will begin on this group of animals). Blood draws (500 ul, tail vein) were taken from Groups 2, 3 and 4, 24 hours after each dose for the first 2 weeks and then 1x/week thereafter. After 4 weeks of dosing, blood sample via tail vein (500 ul) was taken from all animals (Groups 1-5). At the end of 8 weeks of dosing, a 24 hour urine collection was performed (urinary albumin and creatinine measurements) together with a tail vein (500 ul) blood sample from Group 1 (n=18 going into the Treatment arm). Results for urine volume, creatinine, and albumin is shown in FIG. 35. As shown in FIG. 35, treatment with RNA encoding BMP7 Variant A resulted in reduced levels of urine albumin in rats afflicted with diabetic nephropathy compared to the control, indicating superior kidney function in the treated animals compared to the control animals (placebo group). To terminate the study, all animals were euthanized with $CO_2$ asphyxiation and a blood draw was performed via cardiac puncture to collect serum for BUN, creatinine and glucose, and plasma for compound exposure and biomarker analysis. Both kidneys were dissected and fixed for histology. FIG. 34 shows the serum level of BMP7 protein in Groups 1, 2, 3, and 4. Results indicate that the serum levels of BMP7 protein in these groups were as follows: Group 4, Group 3>Group 2, Group 1.

A study was also conducted to analyze the effect of the RNAs encoding BMP7 variants on treating diabetic nephropathy. Specifically, the vehicle animals from Group 1 (Prevention arm, n=18) were randomized based on body weight, glucose and urine albumin (Groups 6, n=20; 7, n=10). Animals received either Vehicle or BMP7 variant-encoding RNAs (intradermal, 2×/week, Mon and Thur), groups 6 and 7, respectively. After 4 weeks of treatment, animals were euthanized with $CO_2$ asphyxiation and a blood draw will be performed via cardiac puncture to collect serum for BUN, creatinine and glucose, and plasma for compound exposure and biomarker analysis. Both kidneys were dissected and fixed for histology. As shown in FIG. 36, treatment with RNA encoding BMP7 Variant A decreased urine albumin level in rats afflicted with diabetic nephropathy, indicating superior kidney function in the treated animals. This result suggested that BMP7 variant-encoding RNA effectively treated diabetic nephropathy and promoted superior kidney function compared to the control animals (placebo group).

An illustrative study protocol is provided below:

| Week | Day | Procedure |
|---|---|---|
| 15 weeks old | −7 | Animals arrive in Room C from the barrier |
| | 0 | BW*, Stat Strip, and Place animals on 5SCA for 3 wks |
| 1 | 7 | BW*, Stat Strip |
| 2 | 14 | BW*, Stat Strip |
| 3 | 21 | BW*, Stat Strip, put animals on 5008 |
| 4 | 28 | BW*, Stat Strip |
| | 34 | BW*, Tail vein blood draw and randomize for Prevention arm (Grps 1, 2, 3, 4, 5) |
| 5 | 35 | Begin 24 hr urine collection |
| | 36 | Collect 24 hr urine |
| | 39 | BW* |
| | | Intradermal dosing Grps 1, 2, 3 and 4, and put Grp 5 on admixed 5008 diet |
| | | Begin food consumption on group 5 |
| | 40 | Collect 24 blood sample for exposure (gps 2, 3, & 4) |
| | 42 | Dosing |
| | 43 | Collect 24 blood sample for exposure (gps 2, 3, & 4) |
| 6 (1 P) | 46 | BW*, Dosing |
| | | Food consumption group 5 |
| | 47 | Collect 24 blood sample for exposure (gps 2, 3, & 4) |
| | 49 | Dosing |
| | 50 | Collect 24 blood sample for exposure (gps 2, 3, & 4) |
| 7 (2 P) | 53 | BW*, Dosing |
| | | Food consumption group 5 |
| | 54 | Collect 24 blood sample for exposure (gps 2, 3, & 4) |
| | 56 | Dosing |
| 8 (3 P) | 60 | BW*, Dosing |
| | | Food consumption group 5 |
| | 61 | Collect 24 blood sample for exposure (gps 2, 3, & 4) |
| | 63 | Dosing |
| 9 (4 P) | 67 | BW*, Dosing |
| | | Food consumption group 5 |
| | | Blood draw (tail vein) |
| | 68 | Blood draw (all groups) |
| | | Collect 24 blood sample for exposure (gps 2, 3, & 4) |
| | 70 | Dosing |
| 10 (5 P) | 74 | BW*, Dosing |
| | | Food consumption group 5 |
| | 75 | Collect 24 blood sample for exposure (gps 2, 3, & 4) |
| | 77 | Dosing |
| 11 (6 P) | 81 | BW*, Dosing |
| | | Food consumption group 5 |
| | | Collect 24 blood sample for exposure (gps 2, 3, & 4) |
| | 84 | Dosing |
| 12 (7 P) | 88 | BW*, Dosing |
| | | Food consumption group 5 |
| | 89 | Collect 24 blood sample for exposure (gps 2, 3, & 4) |
| | 91 | Dosing |
| 13 (8 P) | 95 | BW*, dosing |
| | | Food consumption group 5 |
| | | Blood draw (tail vein) (all groups) |
| | 96 | Begin 24 hr urine collection |
| | 97 | Collect 24 hr urine |
| | | Terminate Groups 1 (n = 6), 2, 3, 4 and 5 cardiac puncture blood draw, and collect kidneys, weigh and fix. |

| Week | Day | Procedure |
|---|---|---|
| | 98 | BW* and randomize (BW*, glucose, albumin) Group 1 (n = 18) rats into Groups 6, 7 and 8 |
| | | Dose |
| | | Food Consumption group 8 |
| | 103 | Dose |
| 14 (1 T) | 106 | BW*, Dosing |
| | | Food Consumption group 8 |
| | 110 | Dosing |
| 15 (2 T) | 113 | BW*, Dosing |
| | | Food Consumption group 8 |
| | 117 | Dosing |
| 16 (3 T) | 120 | BW*, Dosing |
| | | Food Consumption group 8 |
| | 124 | Dosing |
| 17 (4T) | 127 | BW*, Terminate, cardiac puncture blood draw, and collect kidneys, weigh and fix. |

*BW: body weight measurement

In an illustrative study, the protocol was amended from above towards the end of the study as follows:

| Treatment Arm | Day | BW Begin 24 hr urine collection |
|---|---|---|
| | 81 | Collect 24 hr urine |
| | | BW, Blood draw |
| | | Randomize (BW, glucose, albumin) rats into Groups 6 and 7 |
| 1 T | | BW, Dose |
| | | 12 hr PK sample |
| | | Dose |
| | | Dose and Begin 24 hr Urine collection |
| | 89 | Collect 24 hr Urine and Dose |
| 2 T | | BW, Dose |
| | | 12 hr PK sample |
| | | Dose |
| | | Begin 24 hr Urine collection |
| | 96 | Collect 24 hr Urine and Dose |
| 3 T | | BW, Dose |
| | | 12 hr PK sample |
| | | Dose |
| | | Begin 24 hr Urine collection |
| | | Collect 24 hr Urine and Dose (last dose) |
| 4 T | | BW |
| | | No activity |
| | | Begin 24 hr urine collection |
| | | Collect 24 hr urine |
| | | BW, Terminate, cardiac puncture blood draw, and collect kidneys, weigh and fix. |

During both studies, pathological analysis is conducted as follows:

| Specimen to be Collected | Method of Collection | Anti-Coagulant | Specimen to be Analyzed | Clinical Chemistry | Method of Analysis |
|---|---|---|---|---|---|
| Urine | 24 hr Metabolism Cages | NA | Urine | Creatinine/ Albumin | AU480/ ICL Elisa |
| Whole Blood | Tail Vein | None | Serum | BUN Creatinine Glucose/ | AU480/ Sponsor |
| Whole Blood | Cardiac Puncture (Grps 1, 2, 3, 4 and 5; and 6, 7, 8) | None | Serum | BUN Creatinine Glucose/ Cmpd Exp & Biomarker | AU480/ Sponsor |

Altogether, these results suggested that RNAs encoding BMP-7 variants effectively prevented the development of diabetic nephropathy in rats. In addition, these RNAs also effectively treated and restored kidney functions in rats already afflicted with diabetic nephropathy. RNA encoding BMP7 Variant A was particularly effective at preventing and treating diabetic nephropathy in rats.

Example 43: Transfection of Human Keratinocytes with RNA Encoding BDNF, BMP-2, BMP-6, IL-2, IL-6, IL-15, IL-22, LIF or FGF-21

100,000 human epidermal keratinocytes (HEK, Gibco) were plated in EpiLife+Supplement S7. Cells were transfected according to Example 3 with 2 µg of RNA encoding BDNF, BMP-2, BMP-6, IL-2, IL-6, IL-15, IL-22, LIF or FGF-21. 24 hours after transfection, the medium was sampled and secreted protein levels were measured using a human ELISA kit (see Table below) according the manufacturer's instructions. Secreted protein levels were determined by measuring 450 nm absorbance using a microplate reader (EMax Plus, Molecular Devices). Secreted protein levels are shown in FIG. 34, panels A-I.

| Protein | Part Number | Vendor |
|---|---|---|
| BDNF | DBNT00 | R&D Systems |
| BMP-2 | DBP200 | R&D Systems |
| BMP-6 | ab99984 | Abcam |

-continued

| Protein | Part Number | Vendor |
| --- | --- | --- |
| IL-2 | D2050 | R&D Systems |
| IL-6 | D6050 | R&D Systems |
| IL-15 | D1500 | R&D Systems |
| IL-22 | D2200 | R&D Systems |
| LIF | DLF00 | R&D Systems |
| FGF-21 | DF2100 | R&D Systems |

Example 44: Transfection of Human Keratinocytes with RNA Encoding IL-15 and/or IL-15RA 100,000 human epidermal keratinocytes (HEK, Gibco) were plated in EpiLife+Supplement S7. Cells were transfected according to Example 3 with 2 µg of RNA encoding IL-15 or 1 µg each of RNA encoding IL-15 and RNA encoding IL-15RA. 24 hours after transfection, the medium was sampled and secreted IL-15 levels were measured using a human IL-15 ELISA kit (D1500, R&D Systems) according the manufacturer's instructions. Secreted IL-15 levels were determined by measuring 450 nm absorbance using a microplate reader (EMax Plus, Molecular Devices). Secreted IL-15 levels are shown in FIG. 35. As demonstrated in FIG. 35, co-transfection of IL-15 and IL-15RA significantly increased secreted IL-15 levels compared to transfection with IL-15 alone.

Example 45: Pharmacokinetic Study Via Intradermal Injection in Rats

Studies were conducted to evaluate the responses of Sprague Dawley rats to intradermal administration of various RNAs. Specifically, 8-10 weeks old, female Sprague Dawley rats weighing about 200 g to about 350 g were used for this study. A total of 33 rats were tested, and the animals were assigned to study groups and treated as indicated in the Table below:

For the study, the animals were treated with either 4 ug of RNA. All groups were dosed via intradermal injection. Each dose was administered in four intradermal injections of 50 µL/injection for a total of 200 uL per animal. Injections occurred into previously marked sites near the midline of the dorsal lumbar area (upper left, upper right, lower left and lower right quadrants). Dose time (after the last injection) was recorded. Additional markings were made as needed to allow for identification of the dose site. Animals were administered with the RNAs on day 1 and euthanized on day 3. Clinical observations were made on the rats twice daily. Food consumption and body weight were also monitored.

During the study, approximately 1 ml of blood samples was collected from the jugular vein for pharmacokinetic analysis as follows:

| Time Point | PK[a] |
| --- | --- |
| Acclimation | — |
| Day 1 | 12 hours postdose |
| Day 2 | 24 hours postdose |
| Day 3 | 48 hours postdose |

[a]Time points for blood collection (n = 3 animals/Group/Time point)

PK = Pharmacokinetics

Results indicate that following administration of RNAs encoding FGF21, IL15, IL15 and IL15R, IL6, IL22, and NOVEPOEITIN, these proteins were readily detected in the blood with protein levels peaking at approximately 12 hours post injection (FIG. 39). Of note, the proteins tested in this study can be taken up by cells and tissues and/or can exert an effect near the site of expression without appreciable accumulation in systemic circulation.

| Group | Group Color | Test Article | Dose Route | Dose Level (µg) | Dose Concentration (µg/mL) | Dose Volume (µL/per injection)[a] | Number of Animals Females |
| --- | --- | --- | --- | --- | --- | --- | --- |
| 1 | White | Control (NOVEPOEITIN) | ID | 4.0 | 20.0 | 200 (4 × 50) | 3[b] |
| 2 | Yellow | TA1 (IL2) | ID | 4.0 | 20.0 | 200 (4 × 50) | 3[b] |
| 3 | Green | TA2 (IL6) | ID | 4.0 | 20.0 | 200 (4 × 50) | 3[b] |
| 4 | Blue | TA3 (IL15) | ID | 4.0 | 10.0 | 200 (4 × 50) | 3[b] |
| 5 | Red | TA4 (IL15 + IL15RA) | ID | 4.0 | 20.0 (10.0 each) | 200 (4 × 50) | 3[b] |
| 6 | Dark Grey | TA5 (IL22) | ID | 4.0 | 20.0 | 200 (4 × 50) | 3[b] |
| 7 | Purple | TA6 (BMP2) | ID | 4.0 | 20.0 | 200 (4 × 50) | 3[b] |
| 8 | Black | TA7 (BDNF) | ID | 4.0 | 20.0 | 200 (4 × 50) | 3[b] |
| 9 | White/Yellow | TA8 (LIF) | ID | 4.0 | 20.0 | 200 (4 × 50) | 3[b] |
| 10 | Green/Blue | TA9 (PTH) | ID | 4.0 | 20.0 | 200 (4 × 50) | 3[b] |
| 11 | Red/Dark Grey | TA10 (FGF21) | ID | 4.0 | 20.0 | 200 (4 × 50) | 3[b] |

[a]Total dose volume (µL/per animal) was constant. Each animal received four intradermal injections of 50 µL/per injection for a total of 200 µL per animal.
[b]Animals, euthanized on Day 3 without examination or necropsy
Intradermal = ID

EQUIVALENTS

Those skilled in the art will recognize, or be able to ascertain, using no more than routine experimentation, numerous equivalents to the specific embodiments described specifically herein. Such equivalents are intended to be encompassed in the scope of the following claims.

INCORPORATION BY REFERENCE

All patents and publications referenced herein are hereby incorporated by reference in their entireties.

SEQUENCE LISTING (581 sequences)

SEQ ID NO: 1 - protein, 195 aa, Homo sapiens
VLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 2 - protein, 195 aa, Homo sapiens
VLEKSDIEKFKNQLRTELTNIDHSYLKGIDIASKKKTSNVENTEFEAISTKIFTDELGFSGEHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 3 - protein, 195 aa, Homo sapiens
VLEKSDIEKFKNQLRTELTNIDHSYLKGIDIASKPKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 4 - protein, 195 aa, Homo sapiens
VLEKSDIEKFKNQLRTELTNIDHSYLKGIDIASKPKTSNVENTEFEAISTKIFTDELGFSGEHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 5 - protein, 191 aa, Homo sapiens
VLEKSDIEKFKNQLRTELTNIDHSYLKGIDIASKPVENTEFEAISTKIFTDELGFSGEHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 6 - protein, 195 aa, Homo sapiens
VLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGDYKEQLQKFRQDTNHLGGALEFVKLLLLANNYKTQKMSKKEVKKSILDYNISY

SEQ ID NO: 7 - protein, 195 aa, Homo sapiens
VLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGDYKEQLQKFRQNTNHLGGALEFVKLLLLANNYKTQKMSKKEVKKSILDYNISY

SEQ ID NO: 8 - protein, 360 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 9 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 10 - protein, 479 aa, Homo sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 11 - protein, 454 aa, Homo sapiens
MDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 12 - DNA, 191 bp, Homo sapiens
ttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcgggtgagactgcccggcctcctggggtcccccacgcccgcct

SEQ ID NO: 13 - DNA, 190 bp, Homo sapiens
ggctgccacgtccactcacgagctgtgctgtcccttgcagatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttga

SEQ ID NO: 14 - DNA, 198 bp, Homo sapiens
cccttcagctgcctttccgctgttgttttgatttttctagagaggaacataaaaagcattcgtccggttgcgctttcctttctgtcaagaagcagtttgaagaattaacccttggtgaatttttgaaactggacagagaaagagccaagaacaaaattgtatgtattgggaataagaactgctcaaaccctgttcaat

SEQ ID NO: 15 - DNA, 170 bp, Homo sapiens
gctctggtttcagtgtcatgtgtctattctttatttccaggcaaaggaaaccaacaataagaagaaagaatttgaggaaactgcggagaaagtgcgccgtgccatcgagcagctggctgccatggattgaggcctctggccggagctgcctggtcccagagtggctgcac

SEQ ID NO: 16 - DNA, 20 bp, Homo sapiens
ttgccccctgcctggcagcc

SEQ ID NO: 17 - DNA, 20 bp, Homo sapiens
ttcttgaatgtagagatgcg

SEQ ID NO: 18 - DNA, 20 bp, Homo sapiens
tgggtgccccgacgttgccc

SEQ ID NO: 19 - DNA, 20 bp, Homo sapiens
tgcggtggtccttgagaaag

SEQ ID NO: 20 - DNA, 20 bp, Homo sapiens
tcaaggaccaccgcatctct

SEQ ID NO: 21 - DNA, 20 bp, Homo sapiens
tgcaggcgcagccctccaag

SEQ ID NO: 22 - DNA, 20 bp, Homo sapiens
tggccgaggctggcttcatc

SEQ ID NO: 23 - DNA, 20 bp, Homo sapiens
tgggccaagtctggctcgtt

SEQ ID NO: 24 - DNA, 20 bp, Homo sapiens
ttggcccagtgtttcttctg

SEQ ID NO: 25 - DNA, 20 bp, Homo sapiens
tcgtcatctggctcccagcc

SEQ ID NO: 26 - DNA, 20 bp, Homo sapiens
tgcgctttcctttctgtcaa

SEQ ID NO: 27 - DNA, 20 bp, Homo sapiens
tcaaaaattcaccaagggtt

SEQ ID NO: 28 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 29 - protein, 298 aa, Homo sapiens
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 30 - protein, 305 aa, Homo sapiens
MDMFQKVEKIGEGTYGVVYKAKNRETGQLVALKKIRLDLEMEGVPSTAIREISLLKELKHPNIVRLLDVVHNERKLYLVFEFLSQDLKKYMDSTPGSELPLHLIKSYLFQLLQGVSFCHSHRVIHRDLKPQNLLINELGAIKLADFGLARAFGVPLRTYTHEVVTLWYRAPEILLGSKFYTTAVDIWSIGCIFAEMVTRKALFPGDSEIDQLFRIFRMLGTPSEDTWPGVTQLPDYKGSFPKWTRKGLEEIVPNLEPEGRDLLMQLLQYDPSQRITAKTALAHPYFSSPEPSPAARQYVLQRFRH

SEQ ID NO: 31 - protein, 303 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 32 - protein, 292 aa, Homo sapiens
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 33 - protein, 326 aa, Homo sapiens
MEKDGLCRADQQYECVAEIGEGAYGKVFKARDLKNGGRFVALKRVRVQTGEEGMPLSTIREVAVLRHLETFEHPNVVRLFDVCTVSRTDRETKLTLVFEHVDQDLTTYLDKVPEPGVPTETIKDMMFQLLRGLDFLHSHRVVHRDLKPQNILVTSSGQIKLADFGLARIYSFQMALTSVVVTLWYRAPEVLLQSSYATPVDLWSVGCIFAEMFRRKPLFRGSSDVDQLGKILDVIGLPGEEDWPRDVALPRQAFHSKSAQPIEKFVTDIDELGKDLLLKCLTFNPAKRISAYSALSHPYFQDLERCKENLDSHLPPSQNTSELNTA

SEQ ID NO: 34 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAEKVRRAIEQLAAMD

SEQ ID NO: 35 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 36 - protein, 449 aa, Homo sapiens
MGRVGGMAQPMGRAGAPKPMGRAGSARRGRFKGCWSEGSPVHPVPAVLSWLLALLRCASTMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 37 - protein, 188 aa, Homo sapiens [sequence omitted]

SEQ ID NO: 38 - protein, 1210 aa, Homo sapiens [sequence omitted]

SEQ ID NO: 39 - protein, 454 aa, Homo sapiens; identical to SEQ ID NO: 11

SEQ ID NO: 40 - protein, 889 aa, Homo sapiens
MEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGQDFLRASQMNLGMAAWGRLVMNLLPPCSSPSTISPPKGCPRTPTTLREASDPATPSNFLPKKTPLGEEMTPPPKPPRLYLPQEPTSEETPRTKRPHMEPRTRRGPSPPASPTRKPPRLQDFRCLAVLGRGHFGKVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 41 - protein, 1056 aa, Homo sapiens
MASQPNSSAKKKEEKGKNIQVVVRCRPFNLAERKASAHSIVECDPVRKEVSVRTGGLADKSSRKTYTFDMVFGASTKQIDVYRSVVCPILDEVIMGYNCTIFAYGQTGTGKTFTMEGERSPNEEYTWEEDPLAGIIPRTLHQIFEKLTDNGTEFSVKVSLLEIYNEELFDLLNPSSDVSERLQMFDDPRNKRGVIIKGLEEITVHNKDEVYQILEKGAAKRTTAATLMNAYSSRSHSVFSVTIHMKETTIDGEELVKIGKLNLVDLAGSENIGRSGAVDKRAREAGNINQSLLTLGRVITALVERTPHVPYRESKLTRILQDSLGGRTRTSIIATISPASLNLEETLSTLEYAHRAKNILNKPEVNQKLTKKALIKEYTEEIERLKRDLAAAREKNGVYISEENFRVMSGKLTVQEEQIVELIEKIGAVEEELNRVTELFMDNKNELDQCKSDLQNKTQELETTQKHLQETKLQLVKEEYITSALESTEEKLHDAASKLLNTVEETTKDVSGLHSKLDRKKAVDQHNAEAQDIFGKNLNSLFNNMEELIKDGSSKQKAMLEVHKTLFGNLLSSSVSALDTITTVALGSLTSIPENVSTHVSQIFNMILKEQSLAAESKTVLQELINVLKTDLLSSLEMILSPTVVSILKINSQLKHIFKTSLTVADKIEDQKKELDGFLSILCNNLHELQENTICSLVESQKQCGNLTEDLKTIKQTHSQELCKLMNLWTERFCALEEKCENIQKPLSSVQENIQQKSKDIVNKMTFHSQKFCADSDGFSQELRNFNQEGTKLVEESVKHSDKLNGNLEKISQETEQRCESLNTRTVYFSEQWVSSLNEREQELHNLLEVVSQCCEASSSDITEKSDGRKAAHEKQHNIFLDQMTIDEDKLIAQNLELNETIKIGLTKLNCFLEQDLKLDIPTGTTPQRKSYLYPSTLVRTEPREHLLDQLKRKQPELLMMLNCSENNKEETIPDVDVEEAVLGQYTEEPLSQEPSVDAGVDCSSIGGVPFFQHKKSHGKDKENRGINTLERSKVEETTEHLVTKSRLPLRAQINL

SEQ ID NO: 42 - protein, 2825 aa, Homo sapiens
MYASLGSGPVAPLPASVPPSVLGSWSTGGSRSCVRQETKSPGGARTSGHWASVWQEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKVFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 43 - protein, 1863 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 44 - protein, 3418 aa, Homo sapiens
MPIGSKERPTFFEIFKTRCNKADLGPISLNWFEELSSEAPPYNSEPAEESEHKNNNYEPNLFKTPQRKPSYNQLASTPIIFKEQGLTLPLYQSPVKELDKFKLDLGRNVPNSRHKSLRTVKTKMDQADDVSCPLLNSCLSESPVVLQCTHVTPQRDKSVVCGSLFHTPKFVKGRQTPKHISESLGAEVDPDMSWSSSLATPPTLSSTVLIVRNEEASETVFPHDTTANVKSYFSNHDESLKKNDRFIASVTDSENTNQREAASHGFGKTSGNSFKVNSCKDHIGKSMPNVLEDEVYETVVDTSEEDSFSLCFSKCRTKNLQKVRTSKTRKKIFHEANADECEKSKNQVKEKYSFVSEVEPNDTDPLDSNVANQKPFESGSDKISKEVVPSLACEWSQLTLSGLNGAQMEKIPLLHISSCDQNISEKDLLDTENKRKKDFLTSENSLPRISSLPKSEKPLNEETVVNKRDEEQHLESHTDCILAVKQAISGTSPVASSFQGIKKSIFRIRESPKETFNASFSGHMTDPNFKKETEASESGLEIHTVCSQKEDSLCPNLIDNGSWPATTTQNSVALKNAGLISTLKKKTNKFIYAIHDETSYKGKKIPKDQKSELINCSAQFEANAFEAPLTFANADSGLLHSSVKRSCSQNDSEEPTLSLTSSFGTILRKCSRNETCSNNTVISQDLDYKEAKCNKEKLQLFITPEADSLSCLQEGQCENDPKSKKVSDIKEEVLAAACHPVQHSKVEYSDTDFQSQKSLLYDHENASTLILTPTSKDVLSNLVMISRGKESYKMSDKLKGNNYESDVELTKNIPMEKNQDVCALNENYKNVELLPPEKYMRVASPSRKVQFNQNTNLRVIQKNQEETTSISKITVNPDSEELFSDNENNFVFQVANERNNLALGNTKELHETDLTCVNEPIFKNSTMVLYGDTGDKQATQVSIKKDLVYVLAEENKNSVKQHIKMTLGQDLKSDISLNIDKIPEKNNDYMNKWAGLLGPISNHSFGGSFRTASNKEIKLSEHNIKKSKMFFKDIEEQYPTSLACVEIVNTLALDNQKKLSKPQSINTVSAHLQSSVVVSDCKNSHITPQMLFSKQDFNSNHNLTPSQKAEITELSTILEESGSQFEFTQFRKPSYILQKSTFEVPENQMTILKTTSEECRDADLHVIMNAPSIGQVDSSKQFEGTVEIKRKFAGLLKNDCNKSASGYLTDENEVGFRGFYSAHGTKLNVSTEALQKAVKLFSDIENISEETSAEVHPISLSSSKCHDSVVSMFKIENHNDKTVSEKNNKCQLILQNNIEMTTGTFVEEITENYKRNTENEDNKYTAASRNSHNLEFDGSDSSKNDTVCIHKDETDLLFTDQHNICLKLSGQFMKEGNTQIKEDLSDLTFLEVAKAQEACHGNTSNKEQLTATKTEQNIKDFETSDTFFQTASGKNISVAKESFNKIVNFFDQKPEELHNFSLNSELHSDIRKNKMDILSYEETDIVKHKILKESVPVGTGNQLVTFQGQPERDEKIKEPTLLGFHTASGKKVKIAKESLDKVKNLFDEKEQGTSEITSFSHQWAKTLKYREACKDLELACETIEITAAPKCKEMQNSLNNDKNLVSIETVVPPKLLSDNLCRQTENLKTSKSIFLKVKVHENVEKETAKSPATCYTNQSPYSVIENSALAFYTSCSRKTSVSQTSLLEAKKWLREGIFDGQPERINTADYVGNYLYENNSNSTIAENDKNHLSEKQDTYLSNSSMSNSYSYHSDEVYNDSGYLSKNKLDSGIEPVLKNVEDQKNTSFSKVISNVKDANAYPQTVNEDICVEELVTSSSPCKNKNAAIKLSISNSNNFEVGPPAFRIASGKIVCVSHETIKKVKDIFTDSFSKVIKENNENKSKICQTKIMAGCYEALDDSEDILHNSLDNDECSTHSHKVFADIQSEEILQHNQNMSGLEKVSKISPCDVSLETSDICKCSIGKLHKSVSSANTCGIFSTASGKSVQVSDASLQNARQVFSEIEDSTKQVFSKVLFKSNEHSDQLTREENTAIRTPEHLISQKGFSYNVVNSSAFSGFSTASGKQVSILESSLHKVKGVLEEFDLIRTEHSLHYSPTSRQNVSKILPRVDKRNPEHCVNSEMEKTCSKEFKLSNNLNVEGGSSENNHSIKVSPYLSQFQQDKQQLVLGTKVSLVENIHVLGKEQASPKNVKMEIGKTETFSDVPVKTNIEVCSTYSKDSENYFETEAVEIAKAFMEDDELTDSKLPSHATHSLFTCPENEEMVLSNSRIGKRRGEPLILVGEPSIKRNLLNEFDRIIENQEKSLKASKSTPDGTIKDRRLFMHHVSLEPITCVPFRTTKERQEIQNPNFTAPGQEFLSKSHLYEHLTLEKSSSNLAVSGHPFYQVSATRNEKMRHLITTGRPTKVFVPPFKTKSHFHRVEQCVRNINLEENRQKQNIDGHGSDDSKNKINDNEIHQFNKNNSNQAAAVTFTKCEEEPLDLITSLQNARDIQDMRIKKKQRQRVFPQPGSLYLAKTSTLPRISLKAAVGGQVPSACSHKQLYTYGVSKHCIKINSKNAESFQFHTEDYFGKESLWTGKGIQLADGGWLIPSNDGKAGKEEFYRALCDTPGVDPKLISRIWVYNHYRWIIWKLAAMECAFPKEFANRCLSPERVLLQLKYRYDTEIDRSRRSAIKKIMERDDTAAKTLVLCVSDIISLSANISETSSNKTSSADTQKVAIIELTDGWYAVKAQLDPPLLAVLKNGRLTVGQKIILHGAELVGSPDACTPLEAPESLMLKISANSTRPARWYTKLGFFPDPRPFPLPLSSLFSDGGNVGCVDVIIQRAYPIQWMEKTSSGLYIFRNEREEEKEAAKYVEAQQKRLEALFTKIQEEFEEHEENTTKPYLPSRALTRQQVRALQDGAELYEAVKNAADPAYLEGYFSEEQLRALNNHRQMLNDKKQAQIQLEIRKAMESAEQKEQGLSRDVTTVWKLRIVSYSKKEKDSVILSIWRPSSDLYSLLTEGKRYRIYHLATSKSKSKSERANIQLAATKKTQYQQLPVSDEILFQIYQPREPLHFSKFLDPDFQPSCSEVDLIGFVVSVVKKTGLAPFVYLSDECYNLLAIKFWIDLNEDIIKPHMLIAASNLQWRPESKSGLLTLFAGDFSVFSASPKEGHFQETFNKMKNTVENIDILCNEAENKLMHILHANDPKWSTPTKDCTSGPYTAQIIPGTGNKLLMSSPNCEIYYQSPLSLCMAKRKSVSTPVSAQMTSKSCKGEKEIDDQKNCKKRRALDFLSRLPLPPPVSPICTFVSPAAQKAFQPPRSCGTKYETPIKKKELNSPQMTPFKKFNEISLLESNSIADEELALINTQALLSGSTGEKQFISVSESTRTAPTSSEDYLRLKRRCTTSLIKEQESSQASTEECEKNKQDTITTKKYI

SEQ ID NO: 45 - protein, 393 aa, Homo sapiens [sequence omitted]

SEQ ID NO: 46 - protein, 770 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 47 - protein, 3144 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 48 - protein, 89 aa, Homo sapiens
MGILKLQVFLIVLSVALNHLKATPIESHQVEKRKCNTATCATQRLANFLVHSSNNFGAILSSTNVGSNTYGKRNAVEVLKREPLNYLPL

SEQ ID NO: 49 - protein, 776 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKHPTPGSSDPLIQPSSPAVCPEPPSSPKYVSSVTSRTGSSGAKEMKLKGADGKTKIATPRGAAPPGQKGQANATRIPAKTPPAPKTPPSSATKQVQRRPPPAGPRSERGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 50 - protein, 253 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 51 - protein, 140 aa, Homo sapiens
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKNEEGAPQEGILEDMPVDPDNEAYEMPSEEGYQDYEPEA

SEQ ID NO: 52 - protein, 140 aa, Homo sapiens; identical to SEQ ID NO: 51

SEQ ID NO: 53 - protein, 196 aa, Homo sapiens
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 54 - protein, 36 aa, Homo sapiens
  MOD_RES (12)..(13): Any naturally occurring amino acid
LTPEQVVAIASXXGGKQALETVQRLLPVLCQAHGGG

SEQ ID NO: 55 - protein, 36 aa, Homo sapiens
  MOD_RES (12)..(13): Any naturally occurring amino acid
LTPEQVVAIASXXGGKQALETVQRLLPVLCQAGHGG

SEQ ID NO: 56 - protein, 36 aa, Homo sapiens
  MOD_RES (12)..(13): Any naturally occurring amino acid
LTPEQVVAIASXXGGKQALETVQRLLPVLCQAHGSG

SEQ ID NO: 57 - protein, 1089 aa, Homo sapiens
  MOD_RES (188)..(189): Any naturally occurring amino acid
  MOD_RES (224)..(225): Any naturally occurring amino acid
  MOD_RES (258)..(259): Any naturally occurring amino acid
  MOD_RES (294)..(295): Any naturally occurring amino acid
  MOD_RES (328)..(329): Any naturally occurring amino acid
  MOD_RES (364)..(365): Any naturally occurring amino acid
  MOD_RES (398)..(399): Any naturally occurring amino acid
  MOD_RES (434)..(435): Any naturally occurring amino acid
  MOD_RES (468)..(469): Any naturally occurring amino acid
  MOD_RES (504)..(505): Any naturally occurring amino acid
  MOD_RES (538)..(539): Any naturally occurring amino acid
  MOD_RES (574)..(575): Any naturally occurring amino acid
  MOD_RES (608)..(609): Any naturally occurring amino acid
  MOD_RES (644)..(645): Any naturally occurring amino acid
  MOD_RES (678)..(679): Any naturally occurring amino acid
  MOD_RES (714)..(715): Any naturally occurring amino acid
  MOD_RES (748)..(749): Any naturally occurring amino acid
  MOD_RES (784)..(785): Any naturally occurring amino acid
  MOD_RES (818)..(819): Any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 58 - protein, 1107 aa, Homo sapiens
  MOD_RES (188)..(189): Any naturally occurring amino acid
  MOD_RES (224)..(225): Any naturally occurring amino acid
  MOD_RES (260)..(261): Any naturally occurring amino acid
  MOD_RES (296)..(297): Any naturally occurring amino acid
  MOD_RES (332)..(333): Any naturally occurring amino acid
  MOD_RES (368)..(369): Any naturally occurring amino acid
  MOD_RES (404)..(405): Any naturally occurring amino acid
  MOD_RES (440)..(441): Any naturally occurring amino acid
  MOD_RES (476)..(477): Any naturally occurring amino acid
  MOD_RES (512)..(513): Any naturally occurring amino acid
  MOD_RES (548)..(549): Any naturally occurring amino acid
  MOD_RES (584)..(585): Any naturally occurring amino acid
  MOD_RES (620)..(621): Any naturally occurring amino acid
  MOD_RES (656)..(657): Any naturally occurring amino acid
  MOD_RES (692)..(693): Any naturally occurring amino acid
  MOD_RES (728)..(729): Any naturally occurring amino acid
  MOD_RES (764)..(765): Any naturally occurring amino acid
  MOD_RES (800)..(801): Any naturally occurring amino acid
  MOD_RES (836)..(837): Any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 59 - protein, 1086 aa, Homo sapiens
  MOD_RES (188)..(189): Any naturally occurring amino acid
  MOD_RES (224)..(225): Any naturally occurring amino acid
  MOD_RES (258)..(259): Any naturally occurring amino acid
  MOD_RES (294)..(295): Any naturally occurring amino acid
  MOD_RES (328)..(329): Any naturally occurring amino acid
  MOD_RES (364)..(365): Any naturally occurring amino acid
  MOD_RES (398)..(399): Any naturally occurring amino acid
  MOD_RES (434)..(435): Any naturally occurring amino acid
  MOD_RES (468)..(469): Any naturally occurring amino acid
  MOD_RES (504)..(505): Any naturally occurring amino acid
  MOD_RES (538)..(539): Any naturally occurring amino acid
  MOD_RES (574)..(575): Any naturally occurring amino acid
  MOD_RES (608)..(609): Any naturally occurring amino acid
  MOD_RES (644)..(645): Any naturally occurring amino acid
  MOD_RES (678)..(679): Any naturally occurring amino acid
  MOD_RES (714)..(715): Any naturally occurring amino acid
  MOD_RES (748)..(749): Any naturally occurring amino acid
  MOD_RES (784)..(785): Any naturally occurring amino acid
  MOD_RES (818)..(819): Any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGRPALESIVAQLSRPDPALAALTNDHLVALACLGGRPALDAVKKGLPHAPALIKRTNRRIPERTSHRVAGSVLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 60 - protein, 1104 aa, Homo sapiens
  MOD_RES (188)..(189): Any naturally occurring amino acid
  MOD_RES (224)..(225): Any naturally occurring amino acid
  MOD_RES (260)..(261): Any naturally occurring amino acid
  MOD_RES (296)..(297): Any naturally occurring amino acid
  MOD_RES (332)..(333): Any naturally occurring amino acid
  MOD_RES (368)..(369): Any naturally occurring amino acid
  MOD_RES (404)..(405): Any naturally occurring amino acid
  MOD_RES (440)..(441): Any naturally occurring amino acid
  MOD_RES (476)..(477): Any naturally occurring amino acid
  MOD_RES (512)..(513): Any naturally occurring amino acid
  MOD_RES (548)..(549): Any naturally occurring amino acid
  MOD_RES (584)..(585): Any naturally occurring amino acid
  MOD_RES (620)..(621): Any naturally occurring amino acid
  MOD_RES (656)..(657): Any naturally occurring amino acid
  MOD_RES (692)..(693): Any naturally occurring amino acid
  MOD_RES (728)..(729): Any naturally occurring amino acid
  MOD_RES (764)..(765): Any naturally occurring amino acid
  MOD_RES (800)..(801): Any naturally occurring amino acid
  MOD_RES (836)..(837): Any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGRPALESIVAQLSRPDPALAALTNDHLVALACLGGRPALDAVKKGLPHAPALIKRTNRRIPERTSHRVAGSVLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 61 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPAGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 62 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 63 - protein, 1487 aa, Homo sapiens
MIRLGAPQTLVLLTLLVAAVLRCQGQDVQEAGSCVQDGQRYNDKDVWKPEPCRICVCDTGTVLCDDIICEDVKDCLSPEIPFGECCPICPTDLATASGQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 64 - protein, 1418 aa, Homo sapiens
MIRLGAPQTLVLLTLLVAAVLRCQGQDVRQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 65 - protein, 1466 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 66 - protein, 1669 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMTGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 67 - protein, 1712 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 68 - protein, 1670 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTLGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 69 - protein, 1690 aa, Homo sapiens
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIGAKGEKGIPGFPGPRGDPGSYGSPGFPGLKGELGLVGDPGLFGLIGPKGDPGNRGHPGPPGVLVTPPLPLKGPPGDPGFPGRYGETGDVGPPGPPGLLGRPGEACAGMIGPPGPQGFPGLPGLPGEAGIPGRPDSAPGKPGKPGSPGLPGAPGLQGLPGSSVIYCSVGNPGPQGIKGKVGPPGGRGPKGEKGNEGLCACEPGPMGPPGPPGLPGRQGSKGDLGLPGWLGTKGDPGPPGAEGPPGLPGKHGASGPPGNKGAKGDMVVSRVKGHKGERGPDGPPGFPGQPGSHGRDGHAGEKGDPGPPGDHEDATPGGKGFPGPLGPPGKAGPVGPPGLGFPGPPGERGHPGVPGHPGVRGPDGLKGQKGDTISCNVTYPGRHGPPGFDGPPGPKGFPGPQGAPGLSGSDGHKGRPGTPGTAEIPGPPGFRGDMGDPGFGGEKGSSPVGPPGPPGSPGVNGQKGIPGDPAFGHLGPPGKRGLSGVPGIKGPRGDPGCPGAEGPAGIPGFLGLKGPKGREGHAGFPGVPGPPGHSCERGAPGIPGQPGLPGYPGSPGAPGGKGQPGDVGPPGPAGMKGLPGLPGRPGAHGPPGLPGIPGPFGDDGLPGPPGPKGPRGLPGFPGFPGERGKPGAEGCPGAKGEPGEKGMSGLPGDRGLRGAKGAIGPPGDEGEMAIISQKGTPGEPGPPGDDGFPGERGDKGTPGMQGRRGEPGRYGPPGFHRGEPGEKGQPGPPGPPGPPGSTGLRGFIGFPGLPGDQGEPGSPGPPGFSGIDGARGPKGNKGDPASHFGPPGPKGEPGSPGCPGHFGASGEQGLPGIQGPRGSPGRPGPPGSSGPPGCPGDHGMPGLRGQPGEMGDPGPRGLQGDPGIPGPPGIKGPSGSPGLNGLHGLKGQKGTKGASGLHDVGPPGPVGIPGLKGERGDPGSPGISPPGPRGKKGPPGPPGSSGPPGPAGATGRAPKDIPDPGPPGDQGPPGPDGPRGAPGPPGLPGSVDLLRGEPGDCGLPGPPGPPGPPGPPGYKGFPGCDGKDGQKGPVGFPGPQGPHGFPGPPGEKGLPGPPGRKGPTGLPGPRGEPGPPADVDDCPRIPGLPGAPGMRGPEGAMGLPGMRGPSGPGCKGEPGLDGRRGVDGVPGSPGPPGRKGDTGEDGYPGGPGPPGPIGDPGPKGFGPGYLGGFLLVLHSQTDQEPTCPLGMPRLWTGYSLLYLEGQEKAHNQDLGLAGSCLPVFSTLPFAYCNIHQVCHYAQRNDRSYWLASAAPLPMMPLSEEAIRPYVSRCAVCEAPAQAVAVHSQDQSIPPCPQTWRSLWIGYSFLMHTGAGDQGGGQALMSPGSCLEDFRAAPFLECQGRQGTCHFFANKYSFWLTTVKADLQFSSAPAPDTLKESQAQRQKISRCQVCVKYS

SEQ ID NO: 70 - protein, 1685 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 71 - protein, 1691 aa, Homo sapiens
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 72 - protein, 1838 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 73 - protein, 1499 aa, Homo sapiens
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGAKGPTGSPGTSGPPGSAGPPGSPGPQGSTGPQGIRGQPGDPGVPGFKGEAGPKGEPGPHGIQGPIGPPGEEGKRGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 74 - protein, 1745 aa, Homo sapiens
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILERSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTAATVSVPQDGCRLRKGQTKTLFEFSSSRAGFLPLWDVAATDFGQTNQKFGFELGPVCFSS

SEQ ID NO: 75 - protein, 1028 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 76 - protein, 1019 aa, Homo sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 77 - protein, 3177 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 78 - protein, 2944 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 79 - protein, 724 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 80 - protein, 677 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 81 - protein, 692 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 82 - protein, 711 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 83 - protein, 705 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 84 - protein, 706 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 85 - protein, 643 aa, Homo sapiens
MAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 86 - protein, 700 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 87 - protein, 730 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFALLNLAGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 88 - protein, 658 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAGAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 89 - protein, 714 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 90 - protein, 617 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 91 - protein, 786 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGAPGAVPGVPGTGGVPGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 92 - protein, 417 aa, Homo sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 93 - protein, 187 aa, Homo sapiens
MSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 94 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 95 - protein, 1069 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 96 - protein, 2477 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 97 - protein, 2355 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 98 - protein, 2330 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 99 - protein, 2296 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 100 - protein, 2176 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 101 - protein, 657 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 102 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 103 - protein, 1247 aa, Homo sapiens
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYDIDECSEQPSVCGSHTICNNHPGTFRCECVEGYQFSDEGTCVAVVDQRPINYCETGLHNCDIPQRAQCIYTGGSSYTCSCLPGFSGDGQACQDVDECQPSRCHPDAFCYNTPGSFTCQCKPGYQGDGFRCVPGEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 104 - protein, 3075 aa, Homo sapiens
MRGGVLLVLLLCVAAQCRQRGLFPAILNLASNAHISTNATCGEKGPEMFCKLVEHVPGRPVRNPQCRICDGNSANPRERHPISHAIDGTNNWWQSPSIQNGREYHWVTITLDLRQVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRLQRIRTLNADLMTLSHREPKELDPIVTRRYYYSIKDISVGGMCICYGHASSCPWDETTKKLQCQCEHNTCGESCNRCCPGYHQQPWRPGTVSSGNTCEACNCHNKAKDCYYDESVAKQKKSLNTAGQFRGGGVCINCLQNTMGINCETCIDGYYRPHKVSPYEDEPCRPCNCDPVGSLSSVCIKDDLHSDLHNGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPVGQVNSMSGWLVTDLISPRKIPSQQDALGGRHQVSINNTAVMQRLAPKYYWAAPEAYLGNKLTAFGGFLKYTVSYDIPVETVDSNLMSHADVIIKGNGLTLSTQAEGLSLQPYEEYLNVVRLVPENFQDFHSKRQIDRDQLMTVLANVTHLLIRANYNSAKMALYRLESVSLDIASSNAIDLVVAADVEHCECPQGYTGTSCESCLSGYYRVDGILFGGICQPCECHGHAAECNVHGVCIACAHNTTGVHCEQCLPGFYGEPSRGTPGDCQPCACPLTIASNNFSPTCHLNDGDEVVCDWCAPGYSGAWCERCADGYYGNPTVPGESCVPCDCSGNVDPSEAGHCDSVTGECLKCLGNTDGAHCERCADGFYGDAVTAKNCRACECHVKGSHSAVCHLETGLCDCKPNVTGQQCDQCLHGYYGLDSGHGCRPCNCSVAGSVSDGCTDEGQCHCVPGVAGKRCDRCAHGFYAYQDGSCTPCDCPHTQNTCDPETGECVCPPHTQGVKCEECEDGHWGYDAEVGCQACNCSLVGSTHHRCDVVTGHCQCKSKFGGRACDQCSLGYRDFPDCVPCDCDLRGTSGDACNLEQGLCGCVEETGACPCKENVFGPQCNECREGTFALRADNPLGCSPCFCSGLSHLCSELEDYVRTPVTLGSDQPLLRVVSQSNLRGTTEGVYYQAPDFLLDAATVRQHIRAEPFYWRLPQQFQGDQLMAYGGKLKYSVAFYSLDGVGTSNFEPQVLIKGGRIRKQVIYMDAPAPENGVRQEQEVAMRENFWKYFNSVSEKPVTREDFMSVLSDIEYILIKASYGQGLQQSRISDISMEVGRKAEKLHPEEEVASLLENCVCPPGTVGFSCQDCAPGYHRGKLPAGSDRGPRPLVAPCVPCSCNNHSDTCDPNTGKCLNCGDNTAGDHCDVCTSGYYGKVTGSASDCALCACPHSPPASFSPTCVLEGDHDFRCDACLLGYEGKHCERCSSSYYGNPQTPGGSCQKCDCNPHGSVHGDCDRTSGQCVCRLGASGLRCDECEPRHILMETDCVSCDDECVGVLLNDLDEIGDAVLSLNLTGIIPVPYGILSNLENTTKYLQESLLKENMQKDLGKIKLEGVAEETDNLQKKLTRMLASTQKVNRATERIFKESQDLAIAIERLQMSITEIMEKTTLNQTLDEDFLLPNSTLQNMQQNGTSLLEIMQIRDFTQLHQNATLELKAAEDLLSQIQENYQKPLEELEVLKEAASHVLSKHNNELKAAEALVREAEAKMQESNHLLLMVNANLREFSDKKLHVQEEQNLTSELIVQGRGLIDAAAAQTDAVQDALEHLEDHQDKLLLWSAKIRHHIDDLVMHMSQRNAVDLVYRAEDHAAEFQRLADVLYSGLENIRNVSLNATSAAYVHYNIQSLIEESEELARDAHRTVTETSLLSESLVSNGKAAVQRSSRFLKEGNNLSRKLPGIALELSELRNKTNRFQENAVEITRQTNESLLILRAIPKGIRDKGAKTKELATSASQSAVSTLRDVAGLSQELLNTSASLSRVNTTLRETHQLLQDSTMATLLAGRKVKDVEIQANLLFDRLKPLKMLEENLSRNLSEIKLLISQARKQAASIKVAVSADRDCIRAYQPQISSTNYNTLTLNVKTQEPDNLLFYLGSSTASDFLAVEMRRGRVAFLWDLGSGSTRLEFPDFPIDDNRWHSIHVARFGNIGSLSVKEMSSNQKSPTKTSKSPGTANVLDVNNSTLMFVGGLGGQIKKSPAVKVTHFKGCLGEAFLNGKSIGLWNYIEREGKCRGCFGSSQNEDPSFHFDGSGYSVVEKSLPATVTQIIMLFNTFSPNGLLLYLGSYGTKDFLSIELFRGRVKVMTDLGSGPITLLTDRRYNNGTWYKIAFQRNRKQGVLAVIDAYNTSNKETKQGETPGASSDLNRLDKDPIYVGGLPRSRVVRRGVTTKSFVGCIKNLEISRSTFDLLRNSYGVRKGCLLEPIRSVSFLKGGYIELPPKSLSPESEWLVTFATTNSSGIILAALGGDVEKRGDREEAHVPFFSVMLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGHEQVDLDTCWLSERPKLAPDAEDSKLLPEPRAFPEQCVVDAALEYVPGAHQFGLTQNSHFILPFNQSAVRKKLSVELSIRTFASSGLIYYMAHQNQADYAVLQLHGGRLHFMFDLGKGRTKVSHPALLSDGKWHTVKTDYVKRKGFITVDGRESPMVTVVGDGTMLDVEGLFYLGGLPSQYQARKIGNITHSIPACIGDVTVNSKQLDKDSPVSAFTVNRCYAVAQEGTYFDGSGYAALVKEGYKVQSDVNITLEFRTSSQNGVLLGISTAKVDAIGLELVDGKVLFHVNNGAGRITAAYEPKTATVLCDGKWHTLQANKSKHRITLIVDGNAVGAESPHTQSTSVDTNNPIYVGGYPAGVKQKCLRSQTSFRGCLRKLALIKSPQVQSFDFSRAFELHGVFLHSCPGTES

SEQ ID NO: 105 - protein, 158 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGSTFEERK

SEQ ID NO: 106 - protein, 155 aa, Homo sapiens
MAEGEITTFTALTEKFNLPPGNYKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 107 - protein, 288 aa, Homo sapiens
MVGVGGGDVEDVTPRPGGCQISGRGARGCNGIPGAAAWEAALPRRRPRRHPSVNPRSRAAGSPRTRGRRTEERPSGSRLGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 108 - protein, 390 aa, Homo sapiens
MPPSGLRLLPLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 109 - protein, 442 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 110 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 111 - protein, 377 aa, Homo sapiens
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 112 - protein, 377 aa, Homo sapiens
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 113 - protein, 375 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 114 - protein, 377 aa, Homo sapiens
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 115 - protein, 375 aa, Homo sapiens
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 116 - protein, 376 aa, Homo sapiens
MCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 117 - protein, 333 aa, Homo sapiens
MCEEETTALVCDNGSGLCKAGFAGDDAPRAVFPSIVGRPRHQIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 118 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 119 - protein, 204 aa, Homo sapiens
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 120 - protein, 171 aa, Homo sapiens
MAGPATQSPMKLMALQLLLWHSALWTVQEATPLGPASSLPQSFLLKCLEQVRKIQGDGAALQEKLVSEAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 121 - protein, 168 aa, Homo sapiens
MAGPATQSPMKLMALQLLLWHSALWTVQEATPLGPASSLPQSFLLKCLEQVRKIQGDGAALQEKLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 122 - protein, 211 aa, Homo sapiens [sequence omitted]

SEQ ID NO: 123 - protein, 196 aa, Homo sapiens
MRTLACLLLLGCGYLAHVLAEEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 124 - protein, 241 aa, Homo sapiens
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 125 - protein, 226 aa, Homo sapiens
MFIMGLGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 126 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 127 - protein, 370 aa, Homo sapiens
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 128 - protein, 364 aa, Homo sapiens
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 129 - protein, 469 aa, Homo sapiens
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 130 - protein, 403 aa, Homo sapiens
MQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 131 - protein, 467 aa, Homo sapiens [sequence omitted]

SEQ ID NO: 132 - protein, 476 aa, Homo sapiens
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 133 - protein, 470 aa, Homo sapiens
MKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 134 - protein, 2871 aa, Homo sapiens
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSYRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSECCCDGGRGWGPHCEICPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 135 - protein, 2912 aa, Homo sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 136 - protein, 574 aa, Homo sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 137 - protein, 774 aa, Homo sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 138 - protein, 753 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 139 - protein, 608 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 140 - protein, 392 aa, Homo sapiens
MGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 141 - protein, 756 aa, Homo sapiens
MAWSPPATLFLFLLLLGQPPPSRPQSLGTTKLRLVGPESKPEEGRLEVLHQGQWGTVCDDNFAIQEATVACRQLGFEAALTWAHSAKYGQGEGPIWLDNVRCVGTESSLDQCGSNGWGVSDCSHSEDVGVICHPRRHRGYLSETVSNALGPQGRRLEEVRLKPILASAKQHSPVTEGAVEVKYEGHWRQVCDQGWTMNNSRVVCGMLGFPSEVPVDSHYYRKVWDLKMRDPKSRLKSLTNKNSFWIHQVTCLGTEPHMANCQVQVAPARGKLRPACPGGMHAVVSCVAGPHFRPPKTKPQRKGSWAEEPRVRLRSGAQVGEGRVEVLMNRQWGTVCDHRWNLISASVVCRQLGFGSAREALFGARLGQGLGPIHLSEVRCRGYERTLSDCPALEGSQNGCQHENDAAVRCNVPNMGFQNQVRLAGGRIPEEGLLEVQVEVNGVPRWGSVCSENWGLTEAMVACRQLGLGFAIHAYKETWFWSGTPRAQEVVMSGVRCSGTELALQQCQRHGPVHCSHGGGRFLAGVSCMDSAPDLVMNAQLVQETAYLEDRPLSQLYCAHEENCLSKSADHMDWPYGYRRLLRFSTQIYNLGRTDFRPKTGRDSWVWHQCHRHYHSIEVFTHYDLLTLNGSKVAEGHKASFCLEDTNCPTGLQRRYACANFGEQGVTVGCWDTYRHDIDCQWVDITDVGPGNYIFQVIVNPHYEVAESDFSNNMLQCRCKYDGHRVWLHNCHTGNSYPANAELSLEQEQRLRNNLI

SEQ ID NO: 142 - protein, 183 aa, Homo sapiens
MRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 143 - protein, 182 aa, Homo sapiens
MRAAYLFLLFLPGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 144 - protein, 173 aa, Homo sapiens
MSLLGPKVLLFLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 145 - protein, 824 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 146 - protein, 824 aa, Homo sapiens; identical to SEQ ID NO: 145

SEQ ID NO: 147 - protein, 713 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 148 - protein, 589 aa, Homo sapiens
MKLVHLESLEVCGQMMLRSYVQIFYWHKFVSPVGKLTSPKGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 149 - protein, 414 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTE

SEQ ID NO: 150 - protein, 429 aa, Homo sapiens
MRSLGANMAAALRAAGVLLRDPLASSSWRVCQPWRWKSGAAAAAVTTETAQHAQGAKPQVQPQKRYESNIRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 151 - protein, 423 aa, Homo sapiens
MRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 152 - protein, 4061 aa, Homo sapiens
MSTLLENIFAIINLFKQYSKKDKNTDTLSKKELKELLEKEFRQILKNPDDPDMVDVFMDHLDIDHNKKIDFTEFLLMVFKLAQAYYESTRKENLPISGHKHRKHSHHDKHEDNKQEENKENRKRPSSLERRNNRKGNKGRSKSPRETGGKRHESSSEKKERKGYSPTHREEEYGKNHHNSSKKEKNKTENTRLGDNRKRLSERLEEKEDNEEGVYDYENTGRMTQKWIQSGHIATYYTIQDEAYDTTDSLLEENKIYERSRSSDGKSSSQVNRSRHENTSQVPLQESRTRKRRGSRVSQDRDSEGHSEDSERHSGSASRNHHGSAWEQSRDGSRHPRSHDEDRASHGHSADSSRQSGTRHAETSSRGQTASSHEQARSSPGERHGSGHQQSADSSRHSATGRGQASSAVSDRGHRGSSGSQASDSEGHSENSDTQSVSGHGKAGLRQQSHQESTRGRSGERSGRSGSSLYQVSTHEQPDSAHGRTGTSTGGRQGSHHEQARDSSRHSASQEGQDTIRGHPGSSRGGRQGSHHEQSVNRSGHSGSHHSHTTSQGRSDASHGQSGSRSASRQTRNEEQSGDGTRHSGSRHHEASSQADSSRHSQVGQGQSSGPRTSRNQGSSVSQDSDSQGHSEDSERWSGSASRNHHGSAQEQSRDGSRHPRSHHEDRAGHGHSADSSRKSGTRHTQNSSSGQAASSHEQARSSAGERHGSRHQLQSADSSRHSGTGHGQASSAVRDSGHRGSSGSQATDSEGHSEDSDTQSVSGHGQAGHHQQSHQESARDRSGERSRRSGSFLYQVSTHKQSESSHGWTGPSTGVRQGSHHEQARDNSRHSASQDGQDTIRGHPGSSRRGRQGSHHEQSVDRSGHSGSHHSHTTSQGRSDASRGQSGSRSASRTTRNEEQSRDGSRHSGSRHHEASSHADISRHSQAGQGQSEGSRTSRRQGSSVSQDSDSEGHSEDSERWSGSASRNHRGSAQEQSRHGSRHPRSHHEDRAGHGHSADSSRQSGTPHAETSSGGQAASSHEQARSSPGERHGSRHQQSADSSRHSGIPRRQASSAVRDSGHWGSSGSQASDSEGHSEESDTQSVSGHGQDGPHQQSHQESARDWSGGRSGRSGSFIYQVSTHEQSESAHGRTRTSTGRRQGSHHEQARDSSRHSASQEGQDTIRAHPGSRRGGRQGSHHEQSVDRSGHSGSHHSHTTSQGRSDASHGQSGSRSASRQTRKDKQSGDGSRHSGSRHHEAASWADSSRHSQVGQEQSSGSRTSRHQGSSVSQDSDSERHSDDSERLSGSASRNHHGSSREQSRDGSRHPGFHQEDRASHGHSADSSRQSGTHHTESSSHGQAVSSHEQARSSPGERHGSRHQQSADSSRHSGIGHRQASSAVRDSGHRGSSGSQVTNSEGHSEDSDTQSVSAHGQAGPHQQSHKESARGQSGESSGRSRSFLYQVSSHEQSESTHGQTAPSTGGRQGSRHEQARNSSRHSASQDGQDTIRGHPGSSRGGRQGSYHEQSVDRSGHSGYHHSHTTPQGRSDASHGQSGPRSASRQTRNEEQSGDGSRHSGSRHHEPSTRAGSSRHSQVGQGESAGSKTSRRQGSSVSQDRDSEGHSEDSERRSESASRNHYGSAREQSRHGSRNPRSHQEDRASHGHSAESSRQSGTRHAETSSGGQAASSQEQARSSPGERHGSRHQQSADSSTDSGTGRRQDSSVVGDSGNRGSSGSQASDSEGHSEESDTQSVSAHGQAGPHQQSHQESTRGQSGERSGRSGSFLYQVSTHEQSESAHGRTGPSTGGRQRSRHEQARDSSRHSASQEGQDTIRGHPGSSRGGRQGSHYEQSVDSSGHSGSHHSHTTSQERSDVSRGQSGSRSVSRQTRNEKQSGDGSRHSGSRHHEASSRADSSRHSQVGQGQSSGPRTSRNQGSSVSQDSDSQGHSEDSERWSGSASRNHLGSAWEQSRDGSRHPGSHHEDRAGHGHSADSSRQSGTRHTESSSRGQAASSHEQARSSAGERHGSHHQLQSADSSRHSGIGHGQASSAVRDSGHRGYSGSQASDSEGHSEDSDTQSVSAQGKAGPHQQSHKESARGQSGESSGRSGSFLYQVSTHEQSESTHGQSAPSTGGRQGSHYDQAQDSSRHSASQEGQDTIRGHPGPSRGGRQGSHQEQSVDRSGHSGSHHSHTTSQGRSDASRGQSGSRSASRKTYDKEQSGDGSRHSGSHHHEASSWADSSRHSLVGQGQSSGPRTSRPRGSSVSQDSDSEGHSEDSERRSGSASRNHHGSAQEQSRDGSRHPRSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRTGTSTGGRQGSHHKQARDSSRHSTSQEGQDTIHGHPGSSSGGRQGSHYEQLVDRSGHSGSHHSHTTSQGRSDASHGHSGSRSASRQTRNDEQSGDGSRHSGSRHHEASSRADSSGHSQVGQGQSEGPRTSRNWGSSFSQDSDSQGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQDGQDTIRGHPGSSRGGRQGYHHEHSVDSSGHSGSHHSHTTSQGRSDASRGQSGSRSASRTTRNEEQSGDGSRHSGSRHHEASTHADISRHSQAVQGQSEGSRRSRRQGSSVSQDSDSEGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQYGQDTIRGHPGSSRGGRQGYHHEHSVDSSGHSGSHHSHTTSQGRSDASRGQSGSRSASRTTRNEEQSGDSSRHSVSRHHEASTHADISRHSQAVQGQSEGSRRSRRQGSSVSQDSDSEGHSEDSERWSGSASRNHRGSVQEQSRHGSRHPRSHHEDRAGHGHSADRSRQSGTRHAETSSGGQAASSHEQARSSPGERHGSRHQQSADSSRHSGIPRGQASSAVRDSRHWGSSGSQASDSEGHSEESDTQSVSGHGQAGPHQQSHQESARDRSGGRSGRSGSFLYQVSTHEQSESAHGRTRTSTGRRQGSHHEQARDSSRHSASQEGQDTIRGHPGSSRRGRQGSHYEQSVDRSGHSGSHHSHTTSQGRSDASRGQSGSRSASRQTRNDEQSGDGSRHSWSHHHEASTQADSSRHSQSGQGQSAGPRTSRNQGSSVSQDSDSQGHSEDSERWSGSASRNHRGSAQEQSRDGSRHPTSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRAGPSTGGRQGSRHEQARDSSRHSASQEGQDTIRGHPGSRRGGRQGSYHEQSVDRSGHSGSHHSHTTSQGRSDASHGQSGSRSASRETRNEEQSGDGSRHSGSRHHEASTQADSSRHSQSGQGESAGSRRSRRQGSSVSQDSDSEAYPEDSERRSESASRNHHGSSREQSRDGSRHPGSSHRDTASHVQSSPVQSDSSTAKEHGHFSSLSQDSAYHSGIQSRGSPHSSSSYHYQSEGTERQKGQSGLVWRHGSYGSADYDYGESGFRHSQHGSVSYNSNPVVFKERSDICKASAFGKDHPRYYATYINKDPGLCGHSSDISKQLGFSQSQRYYYYE

SEQ ID NO: 153 - protein, 578 aa, Homo sapiens
MRQQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 154 - protein, 577 aa, Homo sapiens
MRQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 155 - protein, 552 aa, Homo sapiens
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 156 - protein, 553 aa, Homo sapiens
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQILNKYDSWISFLSSVRYWMAFNVERACQSYFGCVQCISGPLGMYRNSLLQQFLEDWYHQKFLGSKCSFGDDRHLTNRVLSLGYRTKYTARSKCLTETPTKYLRWLNQQTRWSKSYFREWLYNSLWFHKHHLWMTYESVVTGFFPFFLIATVIQLFYRGRIWNILLFLLTVQLVGIIKATYACFLRGNAEMIFMSLYSLLYMSSLLPAKIFAIATINKSGWGTSGRKTIVVNFIGLIPVSIWVAVLLGGLAYTAYCQDLFSETELAFLVSGAILYGCYWVALLMLYLAIIARRCGKKPEQYSLAFAEV

SEQ ID NO: 157 - protein, 281 aa, Homo sapiens
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQPPGKGMAVEDDQVQAAQVRATEAWSVHQRHVSREQ

SEQ ID NO: 158 - protein, 267 aa, Homo sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 159 - protein, 726 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 160 - protein, 747 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRKRLGMRELLALVPQRATSSRVNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 161 - protein, 341 aa, Homo sapiens
MNIVVEFFVVTFKVLWAFVLAAARWLVRPKEKSVAGQVCLITGAGSGLGRLFALEFARRRALLVLWDINTQSNEETAGMVRHIYRDLEAADAAALQAGNGEEEILPHCNLQVFTYTCDVGKRENVYLTAERVRKEVGEVSVLVNNAGVVSGHHLLECPDELIERTMMVNCHAHFWTTKAFLPTMLEINHGHIVTVASSLGLFSTAGVEDYCASKFGVVGFHESLSHELKAAEKDGIKTTLVCPYLVDTGMFRGCRIRKEIEPFLPPLKPDYCVKQAMKAILTDQPMICTPRLMYIVTFMKSILPFEAVVCMYRFLGADKCMYPFIAQRKQATNNNEAKNGI

SEQ ID NO: 162 - protein, 307 aa, Homo sapiens
MGGLTASDVHPTLGVQLFSAGIAACLADVITFPLDTAKVRLQVQGECPTSSVIRYKGVLGTITAVVKTEGRMKLYSGLPAGLQRQISSASLRIGLYDTVQEFLTAGKETAPSLGSKILAGLTTGGVAVFIGQPTEVVKVRLQAQSHLHGIKPRYTGTYNAYRIIATTEGLTGLWKGTTPNLMRSVIINCTELVTYDLMKEAFVKNNILADDVPCHLVSALIAGFCATAMSSPVDVVKTRFINSPPGQYKSVPNCAMKVFTNEGPTAFFKGLVPSFLRLGSWNVIMFVCFEQLKRELSKSRQTMDCAT

SEQ ID NO: 163 - protein, 529 aa, Homo sapiens [sequence omitted]

SEQ ID NO: 164 - protein, 193 aa, Homo sapiens
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 165 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 166 - protein, 193 aa, Homo sapiens
MGVHECPAWLWLLLSLLSLPLGLPVLGAPPRLICDSRVLERYLLEAKEAENITTGCNETCSLNENITVPDTKVNFYAWKRMEVGQQAVEVWQGLALLSEAVLRGQALLVNSSQVNETLQLHVDKAVSGLRSLTTLLRALGAQKEAISPPDAASAAPLRTITADTFRKLFRVYSNFLRGKLKLYTGEACRTGDR

SEQ ID NO: 167 - protein, 166 aa, Homo sapiens
APPRLICDSRVLERYLLEAKEAENITTGCNETCSLNENITVPDTKVNFYAWKRMEVGQQAVEVWQGLALLSEAVLRGQALLVNSSQVNETLQLHVDKAVSGLRSLTTLLRALGAQKEAISPPDAASAAPLRTITADTFRKLFRVYSNFLRGKLKLYTGEACRTGDR

SEQ ID NO: 168 - RNA, 794 nt, Homo sapiens
uaauacgacucacuauagggacauuugcuucugacacaacuguguucacuagcaaccucaaacagcuagccaccaugggggugcacgaauguccugccuggcuguggcuucuccugucccugcugucgcucccucugggccucccaguccugggcgccccaccacgccucaucugugacagccgaguccuggagagguaccucuuggaggccaaggaggccgagaauaucacgacgggcuguaaugaaaccugcagcuugaaugagaauaucacugucccagacaccaaaguuaauuucuaugccuggaagaggauggaggucgggcagcaggccguagaagucuggcagggccuggcccugcugucggaagcuguccugcggggccaggcccuguuggucaacucuucccaggugaacgagacccugcagcugcauguggauaaagccgucaguggccuucgcagccucaccacucugcuucgggcucugggagcccagaaggaagccaucuccccuccagaugcggccucagcugcuccacuccgaacaaucacugcugacacuuuccgcaaacucuuccgagucuacuccaauuuccuccggggaaagcugaagcuguacacaggggaggccugcaggacaggggacagaugaaccggugcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 169 - protein, 986 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSDKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 170 - protein, 396 aa, Homo sapiens
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 171 - protein, 408 aa, Homo sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 172 - protein, 408 aa, Homo sapiens; identical to SEQ ID NO: 171

SEQ ID NO: 173 - protein, 454 aa, Homo sapiens
MHLTVFLLKGIVGFLWSCWVLVGYAKGGLGDNHVHSSFIYRRLRNHERREIQREILSILGLPHRPRPFSPGKQASSAPLFMLDLYNAMTNEENPEESEYSVRASLAEETRGARKGYPASPNGYPRRIQLSRTTPLTTQSPPLASLHDTNFLNDADMVMSFVNLVERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGDYNTSEQKQACKKHELYVSFRDLGWQDWIIAPEGYAAFYCDGECSFPLNAHMNATNHAIVQTLVHLMFPDHVPKPCCAPTKLNAISVLYFDDSSNVILKKYRNMVVRSCGCH

SEQ ID NO: 174 - protein, 513 aa, Homo sapiens
MPGLGRRAQWLCWWWGLLCSCCGPPPLRPPLPAAAAAAAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 175 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 176 - protein, 402 aa, Homo sapiens
MTALPGPLWLLGLALCALGGGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVHGSHGRQVCRRHELYVSFQDLGWLDWVIAPQGYSAYYCEGECSFPLDSCMNATNHAILQSLVHLMMPDAVPKACCAPTKLSATSVLYYDSSNNVILRKHRNMVVKACGCH

SEQ ID NO: 177 - protein, 372 aa, Homo sapiens
MPPPQQGPCGHHLLLLLALLLPSLPLTRAPVPPGPAAALLQALGLRDEPQGAPRLRPVPPVMWRLFRRRDPQETRSGSRRTSPGVTLQPCHVEELGVAGNIVRHIPDRGAPTRASEPASAAGHCPEWTVVFDLSAVEPAERPSRARLELRFAAAAAAAPEGGWELSVAQAGQGAGADPGPVLLRQLVPALGPPVRAELLGAAWARNASWPRSLRLALALRPRAPAACARLAEASLLLVTLDPRLCHPLARPRRDAEPVLGGGPGGACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 178 - protein, 429 aa, Homo sapiens
MCPGALWVALPLLSLLAGSLQGKPLQSWGRGSAGGNAHSPLGVPGGGLPEHTFNLKMFLENVKVDFLRSLNLSGVPSQDKTRVEPPQYMIDLYNRYTSDKSTTPASNIVRSFSMEDAISITATEDFPFQKHILLFNISIPRHEQITRAELRLYVSCQNHVDPSHDLKGSVVIYDVLDGTDAWDSATETKTFLVSQDIQDEGWETLEVSSAVKRWVRSDSTKSKNKLEVTVESHRKGCDTLDISVPPGSRNLPFFVVFSNDHSSGTKETRLELREMISHEQESVLKKLSKDGSTEAGESSHEEDTDGHVAAGSTLARRKRSAGAGSHCQKTSLRVNFEDIGWDSWIIAPKEYEAYECKGGCFFPLADDVTPTKHAIVQTLVHLKFPTKVGKACCVPTKLSPISVLYKDDMGVPTLKYHYEGMSVAECGCR

SEQ ID NO: 179 - protein, 424 aa, Homo sapiens
MGSLVLTLCALFCLAAYLVSGSPIMNLEQSPLEEDMSLFGDVFSEQDGVDFNTLLQSMKDEFLKTLNLSDIPTQDSAKVDPPEYMLELYNKFATDRTSMPSANIIRSFKNEDLFSQPVSFNGLRKYPLLFNVSIPHHEEVIMAELRLYTLVQRDRMIYDGVDRKITIFEVLESKGDNEGERNMLVLVSGEIYGTNSEWETFDVTDAIRRWQKSGSSTHQLEVHIESKHDEAEDASSGRLEIDTSAQNKHNPLLIVFSDDQSSDKERKEELNEMISHEQLPELDNLGLDSFSSGPGEEALLQMRSNIIYDSTARIRRNAKGNYCKRTPLYIDFKEIGWDSWIIAPPGYEAYECRGVCNYPLAEHLTPTKHAIIQALVHLKNSQKASKACCVPTKLEPISILYLDKGVVTYKFKYEGMAVSECGCR

SEQ ID NO: 180 - protein, 450 aa, Homo sapiens
MDLSAAAALCLWLLSACRPRDGLEAAAVLRAAGAGPVRSPGGGGGGGGGGRTLAQAAGAAAVPAAAVPRARAARRAAGSGFRNGSVVPHHFMMSLYRSLAGRAPAGAAAVSASGHGRADTITGFTDQATQDESAAETGQSFLFDVSSLNDADEVVGAELRVLRRGSPESGPGSWTSPPLLLLSTCPGAARAPRLLYSRAAEPLVGQRWEAFDVADAMRRHRREPRPPRAFCLLLRAVAGPVPSPLALRRLGFGWPGGGGSAAEERAVLVVSSRTQRKESLFREIRAQARALGAALASEPLPDPGTGTASPRAVIGGRRRRRTALAGTRTAQGSGGGAGRGHGRRGRSRCSRKPLHVDFKELGWDDWIIAPLDYEAYHCEGLCDFPLRSHLEPTNHAIIQTLLNSMAPDAAPASCCVPARLSPISILYIDAANNVVYKQYEDMVVEACGCR

SEQ ID NO: 181 - protein, 392 aa, Homo sapiens
MVLLSILRILFLCELVLFMEHRAQMAEGGQSSIALLAEAPTLPLIEELLEESPGEQPRKPRLLGHSLRYMLELYRRSADSHGHPRENRTIGATMVRLVKPLTNVARPHRGTWHIQILGFPLRPNRGLYQLVRATVVYRHHLQLTRFNLSCHVEPWVQKNPTNHFPSSEGDSSKPSLMSNAWKEMDITQLVQQRFWNNKGHRILRLRFMCQQQKDSGGLELWHGTSSLDIAFLLLYFNDTHKSIRKAKFLPRGMEEFMERESLLRRTRQADGISAEVTASSSKHSGPENNQCSLHPFQISFRQLGWDHWIIAPPFYTPNYCKGTCLRVLRDGLNSPNHAIIQNLINQLVDQSVPRPSCVPYKYVPISVLMIEANGSILYKEYEGMIAESCTCR

SEQ ID NO: 182 - protein, 366 aa, Homo sapiens [sequence omitted]

SEQ ID NO: 183 - protein, 366 aa, Homo sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 184 - protein, 366 aa, Homo sapiens
MVLHLLLFLLLTPQGGHSCQGLELARELVLAKVRALFLDALGPPAVTREGGDPGVRRLPRRHALGGFTHRGSEPEEEEDVSQAILFPATDASCEDKSAARGLAQEAEEGLFRYMFRPSQHTRSRQVTSAQLWFHTGLDRQGTAASNSSEPLLGLLALSPGGPVAVPMSLGHAPPHWAVLHLATSALSLLTHPVLVLLLRCPLCTCSARPEATPFLVAHTRTRPPSGGERARRSTPLMSWPWSPSALRLLQRPPEEPAAHANCHRVALNISFQELGWERWIVYPPSFIFHYCHGGCGLHIPPNLSLPVPGAPPTPAQPYSLLPGAQPCCAALPGTMRPLHVRTTSDGGYSFKYETVPNLLTQHCACI

SEQ ID NO: 185 - protein, 426 aa, Homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 186 - protein, 407 aa, Homo sapiens
MDGLPGRALGAACLLLLAAGWLGPEAWGSPTPPPTPAAPPPPPPPGSPGGSQDTCTSCGGFRRPEELGRVDGDFLEAVKRHILSRLQMRGRPNITHAVPKAAMVTALRKLHAGKVREDGRVEIPHLDGHASPGADGQERVSEIISFAETDGLASSRVRLYFFISNEGNQNLFVVQASLWLYLKLLPYVLEKGSRRKVRVKVYFQEQGHGDRWNMVEKRVDLKRSGWHTFPLTEAIQALFERGERRLNLDVQCDSCQELAVVPVFVDPGEESHRPFVVVQARLGDSRHRIRKRGLECDGRTNLCCRQQFFIDFRLIGWNDWIIAPTGYYGNYCEGSCPAYLAGVPGSASSFHTAVVNQYRMRGLNPGTVNSCCIPTKLSTMSMLYFDDEYNIVKRDVPNMIVEECGCA

SEQ ID NO: 187 - protein, 267 aa, Homo sapiens
MHLLLFQLLVLLPLGKTTRHQDGRQNQSSLSPVLLPRNQRELPTGNHEEAEEKPDLFVAVPHLVATSPAGEGQRQREKMLSRFGRFWKKPEREMHPSRDSDSEPFPPGTQSLIQPIDGMKMEKSPLREEAKKFWHHFMFRKTPASQGVILPIKSHEVHWETCRTVPFSQTITHEGCEKVVVQNNLCFGKCGSVHFPGAAQHSHTSCSHCLPAKFTTMHLPLNCTELSSVIKVVMLVEECQCKVKTEHEDGHILHAGSQDSFIPGVSA

SEQ ID NO: 188 - protein, 1038 aa, Homo sapiens
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERNLSHNRRVPKIGPYPDYSSSSYIEDSIHHTDSIVKNISSEHSMSSTPLTIGEKNRNSINYERQQAQARIPSPETSVTSLSTNTTTTNTTGLTPSTGMTTISEMPYPDETNLHTTNVAQSIGPTPVCLQLTEEDLETNKLDPKEVDKNLKESSDENLMEHSLKQFSGPDPLSSTSSSLLYPLIKLAVEATGQQDFTQTANGQACLIPDVLPTQIYPLPKQQNLPKRPTSLPLNTKNSTKEPRLKFGSKHKSNLKQVETGVAKMNTINAAEPHVVTVTMNGVAGRNHSVNSHAATTQYANGTVLSGQTTNIVTHRAQEMLQNQFIGEDTRLNINSSPDEHEPLLRREQQAGHDEGVLDRLVDRRERPLEGGRTNSNNNNSNPCSEQDVLAQGVPSTAADPGPSKPRRAQRPNSLDLSATNVLDGSSIQIGESTQDGKSGSGEKIKKRVKTPYSLKRWRPSTWVISTESLDCEVNNNGSNRAVHSKSSTAVYLAEGGTATTMVSKDIGMNCL

SEQ ID NO: 189 - protein, 794 aa, Homo sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 190 - protein, 390 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 191 - protein, 414 aa, Homo sapiens; identical to SEQ ID NO: 110

SEQ ID NO: 192 - protein, 202 aa, Homo sapiens
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 193 - protein, 1821 aa, Homo sapiens
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 194 - protein, 501 aa, Homo sapiens
MRLPKLLTFLLWYLAWLDLEFICTVLGAPDLGQRPQGTRPGLAKAEAKERPPLARNVFRPGGHSYGGGATNANARAKGGTGQTGGLTQPKKDEPKKLPPRPGGPEPKPGHPPQTRQATARTVTPKGQLPGGKAPPKAGSVPSSFLLKKAREPGPPREPKEPFRPPPITPHEYMLSLYRTLSDADRKGGNSSVKLEAGLANTITSFIDKGQDDRGPVVRKQRYVFDISALEKDGLLGAELRILRKKPSDTAKPAAPGGGRAAQLKLSSCPSGRQPASLLDVRSVPGLDGSGWEVFDIWKLFRNFKNSAQLCLELEAWERGRAVDLRGLGFDRAARQVHEKALFLVFGRTKKRDLFFNEIKARSGQDDKTVYEYLFSQRRKRRAPLATRQGKRPSKNLKARCSRKALHVNFKDMGWDDWIIAPLEYEAFHCEGLCEFPLRSHLEPTNHAVIQTLMNSMDPESTPPTCCVPTRLSPISILFIDSANNVVYKQYEDMVVESCGCR

SEQ ID NO: 195 - protein, 184 aa, Homo sapiens
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 196 - protein, 108 aa, Homo sapiens
MKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 197 - protein, 323 aa, Homo sapiens
MAYVPAPGYQPTYNPTLPYYQPIPGGLNVGMSVYIQGVASEHMKRFFVNFVVGQDPGSDVAFHFNPRFDGWDKVVFNTLQGGKWGSEERKRSMPFKKGAAFELVFIVLAEHYKVVVNGNPFYEYGHRLPLQMVTHLQVDGDLQLQSINFIGGQPLRPQGPPMMPPYPGPGHCHQQLNSLPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 198 - protein, 244 aa, Homo sapiens
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNDSTFTGFLLYHDTN

SEQ ID NO: 199 - protein, 245 aa, Homo sapiens
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 200 - protein, 672 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLSAIRAVAKNTTPGAALPAGEWGTVQLRGSWRVGQTAGGSRNFASYPTNPCFPFSVPEGPGPRCVRITLHQHCRPSDTEFHPIGFHIFQVPEGGRSQDAPPLLLQEPLLSCVPHRYAQEVSRLCLLPAGTYKVVPSTYLPDTEGAFTVTIATRIDRPSIHSQEMLGQFLQEVSIMAVMKT

SEQ ID NO: 201 - protein, 544 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVEKRRVNLPRVLSMPPVAGTACHAYDREVHLRCELSPGYYLAVPSTFLKDAPGEFLLRVFSTGRVSLRALAPAASASLCISTAGPVTPSSTPSASISSRSQRVEGARTHPHCCCRSRC

SEQ ID NO: 202 - protein, 517 aa, Homo sapiens
MRAGRGATPARELFRDAAFPAADSSLFCDLSTPLAQFREDITWRRPQEICATPRLFPDDPREGQVKQGLLGDCWFLCACAALQKSRHLLDQVIPPGQPSWADQEYRGSFTCRIWQFGRWVEVTTDDRLPCLAGRLCFSRCQREDVFWLPLLEKVYAKVHGSYEHLWAGQVADALVDLTGGLAERWNLKGVAGSGGQQDRPGRWEHRTCRQLLHLKDQCLISCCVLSPRAGARELGEFHAFIVSDLRELQGQAGQCILLLRIQNPWGRRCWQGLWREGGEGWSQVDAAVASELLSQLQEGEFWVEEEEFLREFDELTVGYPVTEAGHLQSLYTERLLCHTRALPGAWVKGQSAGGCRNNSGFPSNPKFWLRVSEPSEVYIAVLQRSRLHAADWAGRARALVGDSHTSWSPASIPGKHYQAVGLHLWKVPEGGRSQDAPPLLLQEPLLSCVPHRYAQEVSRLCLLPAGTYKVVPSTYLPDTEGAFTVTIATRIDRPSIHSQEMLGQFLQEVSIMAVMKT

SEQ ID NO: 203 - protein, 370 aa, Homo sapiens; identical to SEQ ID NO: 127

SEQ ID NO: 204 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 205 - protein, 1447 aa, Homo sapiens
MASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 206 - protein, 1203 aa, Homo sapiens
MTRSPPLRELPPSYTPPARTAAPQILAGSLKAPLWLRAYFQGLLFSLGCGIQRHCGKVLFLGLLAFGALALGLRMAIIETNLEQLWVEVGSRVSQELHYTKEKLGEEAAYTSQMLIQTARQEGENILTPEALGLHLQAALTASKVQVSLYGKSWDLNKICYKSGVPLIENGMIERMIEKLFPCVILTPLDCFWEGAKLQGGSAYLPGRPDIQWTNLDPEQLLEELGPFASLEGFRELLDKAQVGQAYVGRPCLHPDDLHCPPSAPNHHSRQAPNVAHELSGGCHGFSHKFMHWQEELLLGGMARDPQGELLRAEALQSTFLLMSPRQLYEHFRGDYQTHDIGWSEEQASTVLQAWQRRFVQLAQEALPENASQQIHAFSSTTLDDILHAFSEVSAARVVGGYLLMLAYACVTMLRWDCAQSQGSVGLAGVLLVALAVASGLGLCALLGITFNAATTQVLPFLALGIGVDDVFLLAHAFTEALPGTPLQERMGECLQRTGTSVVLTSINNMAAFLMAALVPIPALRAFSLQAAIVVGCTFVAVMLVFPAILSLDLRRRHCQRLDVLCCFSSPCSAQVIQILPQELGDGTVPVGIAHLTATVQAFTHCEASSQHVVTILPPQAHLVPPPSDPLGSELFSPGGSTRDLLGQEEETRQKAACKSLPCARWNLAHFARYQFAPLLLQSHAKAIVLVLFGALLGLSLYGATLVQDGLALTDVVPRGTKEHAFLSAQLRYFSLYEVALVTQGGFDYAHSQRALFDLHQRFSSLKAVLPPPATQAPRTWLHYYRNWLQGIQAAFDQDWASGRITRHSYRNGSEDGALAYKLLIQTGDAQEPLDFSQLTTRKLVDREGLIPPELFYMGLTVWVSSDPLGLAASQANFYPPPPEWLHDKYDTTGENLRIPPAQPLEFAQFPFLLRGLQKTADFVEAIEGARAACAEAGQAGVHAYPSGSPFLFWEQYLGLRRCFLLAVCILLVCTFLVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRWGASSSLPQSFARVTTSMTVAIHPPPLPGAYIHPAPDEPPWSPAATSSGNLSSRGPGPATG

SEQ ID NO: 207 - protein, 375 aa, Homo sapiens
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 208 - protein, 1754 aa, Homo sapiens
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 209 - protein, 155 aa, Homo sapiens; identical to SEQ ID NO: 106

SEQ ID NO: 210 - protein, 288 aa, Homo sapiens; identical to SEQ ID NO: 107

SEQ ID NO: 211 - protein, 239 aa, Homo sapiens
MGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 212 - protein, 206 aa, Homo sapiens
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 213 - protein, 268 aa, Homo sapiens
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 214 - protein, 208 aa, Homo sapiens
MALGQKLFITMSRGAGRLQGTLWALVFLGILVGMVVPSPAGTRANNTLLDSRGWGTLLSRSRAGLAGEIAGVNWESGYLVGIKRQRRLYCNVGIGFHLQVLPDGRISGTHEENPYSLLEISTVERGVVSLFGVRSALFVAMNSKGRLYATPSFQEECKFRETLLPNNYNAYESDLYQGTYIALSKYGRVKRGSKVSPIMTVTHFLPRI

SEQ ID NO: 215 - protein, 233 aa, Homo sapiens
MGSPRSALSCLLLHLLVLCLQAQEGPGRGPALGRELASLFRAGREPQGVSQQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 216 - protein, 208 aa, Homo sapiens
MAPLGEVGNYFGVQDAVPFGNVPVLPVDSPVLLSDHLGQSEAGGLPRGPAVTDLDHLKGILRRRQLYCRTGFHLEIFPNGTIQGTRKDHSRFGILEFISIAVGLVSIRGVDSGLYLGMNEKGELYGSEKLTQECVFREQFEENWYNTYSSNLYKHVDTGRRYYVALNKDGTPREGTRTKRHQKFTHFLPRPVDPDKVPELYKDILSQS

SEQ ID NO: 217 - protein, 243 aa, Homo sapiens
MAAAIASSLIRQKRQARESNSDRVSASKRRSSPSKDGRSLCERHVLGVFSKVRFCSGRKRPVRRRPEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 218 - protein, 216 aa, Homo sapiens
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 219 - protein, 207 aa, Homo sapiens
MAEVGGVFASLDWDLHGFSSSLGNVPLADSPGFLNERLGQIEGKLQRGSPTDFAHLKGILRRRQLYCRTGFHLEIFPNGTVHGTRHDHSRFGILEFISLAVGLISIRGVDSGLYLGMNERGELYGSKKLTRECVFREQFEENWYNTYASTLYKHSDSERQYYVALNKDGSPREGYRTKRHQKFTHFLPRPVDPSKLPSMSRDLFHYR

SEQ ID NO: 220 - protein, 207 aa, Homo sapiens
MYSAPSACTCLCLHFLLLCFQVQVLVAEENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 221 - protein, 235 aa, Homo sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 222 - protein, 110 aa, Homo sapiens
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDR

SEQ ID NO: 223 - protein, 147 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 224 - protein, 145 aa, Homo sapiens
APMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVCDKPRR

SEQ ID NO: 225 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 226 - protein, 215 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 227 - protein, 232 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 228 - protein, 345 aa, Homo sapiens; identical to SEQ ID NO: 126

SEQ ID NO: 229 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 230 - protein, 1338 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 231 - protein, 1363 aa, Homo sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFSCKGPGQNVAVTRAHPDSQGRRRRPERGARGGQVFYNSEYGELSEPSEEDHCSPSARVTFFTDNSY

SEQ ID NO: 232 - protein, 923 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 233 - protein, 931 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 234 - protein, 160 aa, Homo sapiens
MTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNADGYIDPEELAEIFRASGEHVTDEEIESLMKDGDKNNDGRIDFDEFLKMMEGVQ

SEQ ID NO: 235 - protein, 182 aa, Homo sapiens
MGDEEKRNRAITARRQHLKSVMLQIAATELEKEESRREAEKQNYLAEHCPPLHIPGSMSEVQELCKQLHAKIDAAEEEKYDMEVRVQKTSKELEDMNQKLFDLRGKFKRPPLRRVRMSADAMLKALLGSKHKVCMDLRANLKQVKKEDTEKERDLRDVGDWRKNIEEKSGMEGRKKMFESES

SEQ ID NO: 236 - protein, 258 aa, Homo sapiens
MSDEEVEQVEEQYEEEEEAQEEEEVQEDTAEEDAEEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 237 - protein, 153 aa, Homo sapiens
  MISC_FEATURE (79)..(79): S-carboxyamidomethylcysteine
  MISC_FEATURE (96)..(96): S-carboxyamidomethylcysteine
ADGSSDAAREPRPAPAPIRRRSSNYRAYATEPHAKKKSKISASRKLQLKTLLLQIAKQELEREAEERRGEKGRALSTRCQPLELTGLGFAELQDLCRQLHARVDKVDEERYDIEAKVTKNITEIADLTQKIFDLRGKFKRPTLRRVRISADAM

SEQ ID NO: 238 - protein, 402 aa, Homo sapiens [sequence omitted]

SEQ ID NO: 239 - protein, 415 aa, Homo sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVYIPQFKLEEHYELRSILRSMGMEDAFNKGRANFSGMSERNDLFLSEVFHQAMVDVNEEGTEAAAGTGGVMTGRTGHGGPQFVADHPFLFLIMHKITNCILFFGRFSSP

SEQ ID NO: 240 - protein, 368 aa, Homo sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 241 - protein, 91 aa, Homo sapiens
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 242 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 243 - protein, 378 aa, Homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 244 - protein, 397 aa, Homo sapiens
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 245 - protein, 97 aa, Homo sapiens
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 246 - protein, 134 aa, Homo sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 247 - protein, 114 aa, Homo sapiens
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 248 - protein, 96 aa, Homo sapiens
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 249 - protein, 98 aa, Homo sapiens
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 250 - protein, 353 aa, Homo sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLNGTRGLFPGPSRRTLGAPDISSGTSDTGSLPPNLQPGYSPSPTHPPTGQYTLFPLPPTLPTPVVQLHPLLPDPSAPTPTPTSPLLNTSYTHSQNLSQEG

SEQ ID NO: 251 - protein, 273 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 252 - protein, 149 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERCGDAVPRR

SEQ ID NO: 253 - protein, 170 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 254 - protein, 241 aa, Homo sapiens
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 255 - protein, 257 aa, Homo sapiens
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 256 - protein, 210 aa, Homo sapiens
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKADNAEEGGPGAGGGGCRGVDRRHWVSECKAKQSYVRALTADAQGRVGWRWIRIDTACVCTLLSRTGRA

SEQ ID NO: 257 - protein, 211 aa, Homo sapiens [sequence omitted]

SEQ ID NO: 258 - protein, 241 aa, Homo sapiens; identical to SEQ ID NO: 124

SEQ ID NO: 259 - protein, 89 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNK

SEQ ID NO: 260 - protein, 93 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 261 - protein, 94 aa, Homo sapiens
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 262 - protein, 227 aa, Homo sapiens
MNIKGSPWKGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 263 - protein, 116 aa, Homo sapiens
MDYYRKYAAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 264 - protein, 129 aa, Homo sapiens
MKTLQFFFLFCCWKAICCNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKE

SEQ ID NO: 265 - protein, 125 aa, Homo sapiens
MAGPSLACCLLGLLALTSACYIQNCPLGGKRAAPDLDVRKCLPCGPGGKGRCFGPNICCAEELGCFVGTAEALRCQEENYLPSPCQSGQKACGSGGRCAVLGLCCSPDGCHADPACDAEATFSQR

SEQ ID NO: 266 - protein, 164 aa, Homo sapiens
MPDTMLPACFLGLLAFSSACYFQNCPRGGKRAMSDLELRQCLPCGPGGKGRCFGPSICCADELGCFVGTAEALRCQEENYLPSPCQSGQKACGSGGRCAAFGVCCNDESCVTEPECREGFHRRARASDRSNATQLDGPAGALLLRLVQLAGAPEPFEPAQPDAY

SEQ ID NO: 267 - protein, 269 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 268 - protein, 153 aa, Homo sapiens [sequence omitted]

SEQ ID NO: 269 - protein, 271 aa, Homo sapiens
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 270 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 271 - protein, 146 aa, Homo sapiens [sequence omitted]

SEQ ID NO: 272 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 273 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 274 - protein, 269 aa, Homo sapiens; identical to SEQ ID NO: 267

SEQ ID NO: 275 - protein, 350 aa, Homo sapiens [sequence omitted]

SEQ ID NO: 276 - protein, 177 aa, Homo sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 277 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 278 - protein, 470 aa, Homo sapiens
MGKPWLRALQLLLLLGASWARAGAPRCTYTFVLPPQKFTGAVCWSGPASTRATPEAANASELAALRMRVGRHEELLRELQRLAAADGAVAGEVRALRKESRGLSARLGQLRAQLQHEAGPGAGPGADLGAEPAAALALLGERVLNASAEAQRAAARFHQLDVKFRELAQLVTQQSSLIARLERLCPGGAGGQQQVLPPPPLVPVVPVRLVGSTSDTSRMLDPAPEPQRDQTQRQQEPMASPMPAGHPAVPTKPVGPWQDCAEARQAGHEQSGVYELRVGRHVVSVWCEQQLEGGGWTVIQRRQDGSVNFFTTWQHYKAGFGRPDGEYWLGLEPVYQLTSRGDHELLVLLEDWGGRGARAHYDGFSLEPESDHYRLRLGQYHGDAGDSLSWHNDKPFSTVDRDRDSYSGNCALYQRGGWWYHACAHSNLNGVWHHGGHYRSRYQDGVYWAEFRGGAYSLRKAAMLIRPLKL

SEQ ID NO: 279 - protein, 144 aa, Homo sapiens
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 280 - protein, 152 aa, Homo sapiens
MSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 281 - protein, 134 aa, Homo sapiens
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 282 - protein, 1332 aa, Homo sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 283 - protein, 193 aa, Homo sapiens
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 284 - protein, 219 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 285 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 286 - protein, 153 aa, Homo sapiens [sequence omitted]

SEQ ID NO: 287 - protein, 154 aa, Homo sapiens
MVLSGALCFRMKDSALKVLYLHNNQLLAGGLHAGKVIKGEEISWPNRWLDASLSPVILGVQGGSQCLSCGVGQEPTLTLEPVNIMELYLGAKESKSFTFYRRDMGLTSSFESAAYPGWFLCTVPEADQPVRLTQLPENGGWNAPITDFYFQQCD

SEQ ID NO: 288 - protein, 199 aa, Homo sapiens
MNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 289 - protein, 546 aa, Homo sapiens
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDRDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 290 - protein, 866 aa, Homo sapiens
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 291 - protein, 155 aa, Homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 292 - protein, 177 aa, Homo sapiens
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 293 - protein, 155 aa, Homo sapiens
MERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 294 - protein, 350 aa, Homo sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 295 - protein, 360 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 296 - protein, 398 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 297 - protein, 422 aa, Homo sapiens
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLWLRLRRGGKDGSPKPGFLASVIPVDRRPGAPNL

SEQ ID NO: 298 - protein, 427 aa, Homo sapiens
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 299 - protein, 380 aa, Homo sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 300 - protein, 825 aa, Homo sapiens
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 301 - protein, 862 aa, Homo sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 302 - protein, 662 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 303 - protein, 521 aa, Homo sapiens
MGLGRCIWEGWTLESEALRRDMGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHGAGVLLSQDCAGTPQGALEPCVQEATALLTCGPARPWKSVALEEEQEGPGTRLPGNLSSEDVLPAGCTEWRVQTLAYLPQEDWAPTSLTRPAPPDSEGSRSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 304 - protein, 578 aa, Homo sapiens
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 305 - protein, 325 aa, Homo sapiens
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 306 - protein, 468 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 307 - protein, 378 aa, Homo sapiens
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 308 - protein, 400 aa, Homo sapiens
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 309 - protein, 897 aa, Homo sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 310 - protein, 420 aa, Homo sapiens
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 311 - protein, 459 aa, Homo sapiens [sequence omitted]

SEQ ID NO: 312 - protein, 508 aa, Homo sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 313 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 314 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 315 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 316 - protein, 260 aa, Homo sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCHYSCPREEEGSTIPIQEDYRKPEPACSP

SEQ ID NO: 317 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 318 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 319 - protein, 448 aa, Homo sapiens
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 320 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 321 - protein, 293 aa, Homo sapiens
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 322 - protein, 455 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 323 - protein, 461 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 324 - protein, 423 aa, Homo sapiens
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQVRQRLGSL

SEQ ID NO: 325 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 326 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 327 - protein, 244 aa, Homo sapiens
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 328 - protein, 317 aa, Homo sapiens
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 329 - protein, 281 aa, Homo sapiens; identical to SEQ ID NO: 204

SEQ ID NO: 330 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 331 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 332 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 333 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 334 - protein, 300 aa, Homo sapiens
MRALEGPGLSLLCLVLALPALLPVPAVRGVAETPTYPWRDAETGERLVCAQCPPGTFVQRPCRRDSPTTCGPCPPRHYTQFWNYLERCRYCNVLCGEREEEARACHATHNRACRCRTGFFAHAGFCLEHASCPPGAGVIAPGTPSQNTQCQPCPPGTFSASSSSSEQCQPHRNCTALGLALNVPGSSSHDTLCTSCTGFPLSTRVPGAEECERAVIDFVAFQDISIKRLQRLLQALEAPEGWGPTPRAGRAALQLKLRRRLTELLGAQDGALLVRLLQALRVARMPGLERSVRERFLPVH

SEQ ID NO: 335 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 336 - protein, 99 aa, Homo sapiens
MKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 337 - protein, 99 aa, Homo sapiens
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 338 - protein, 107 aa, Homo sapiens
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 339 - protein, 107 aa, Homo sapiens
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 340 - protein, 107 aa, Homo sapiens
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 341 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 342 - protein, 113 aa, Homo sapiens
MKVSVAALSCLMLVAVLGSQAQFINDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 343 - protein, 93 aa, Homo sapiens
MKISVAAIPFFLLITIALGTKTESSSRGPYHPSECCFTYTTYKIPRQRIMDYYETNSQCSKPGIVFITKRGHSVCTNPSDKWVQDYIKDMKEN

SEQ ID NO: 344 - protein, 99 aa, Homo sapiens
MKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 345 - protein, 93 aa, Homo sapiens
MDRLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 346 - protein, 134 aa, Homo sapiens; identical to SEQ ID NO: 246

SEQ ID NO: 347 - protein, 98 aa, Homo sapiens
MKVSAVLLCLLLMTAAFNPQGLAQPDALNVPSTCCFTFSSKKISLQRLKSYVITTSRCPQKAVIFRTKLGKEICADPKEKWVQNYMKHLGRKAHTLKT

SEQ ID NO: 348 - protein, 150 aa, Homo sapiens
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 349 - protein, 94 aa, Homo sapiens
MMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 350 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 351 - protein, 125 aa, Homo sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 352 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 353 - protein, 128 aa, Homo sapiens
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 354 - protein, 85 aa, Homo sapiens
NLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 355 - protein, 81 aa, Homo sapiens
GKEESLDSDLYAELRCMCIKTTSGIHPKNIQSLEVIGKGTHCNQVEVIATLKDGRKICLDPDAPRIKKIVQKKLAGDESAD

SEQ ID NO: 356 - protein, 70 aa, Homo sapiens
AELRCMCIKTTSGIHPKNIQSLEVIGKGTHCNQVEVIATLKDGRKICLDPDAPRIKKIVQKKLAGDESAD

SEQ ID NO: 357 - protein, 114 aa, Homo sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 358 - protein, 92 aa, Homo sapiens
MKLCVTVLSLLMLVAAFCSPALSAPMGSDPPTACCFSYTARKLPRNFVVDYYETSSLCSQPAVVFQTKRSKQVCADPSESWVQEYVYDLELN

SEQ ID NO: 359 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 360 - protein, 96 aa, Homo sapiens
MQIITTALVCLLLAGMWPEDVDSKSMQVPFSRCCFSFAEQEIPLRAILCYRNTSSICSNEGLIFKLKRGKEACALDTVGWVQRHRKMLRHCPSKRK

SEQ ID NO: 361 - protein, 93 aa, Homo sapiens; identical to SEQ ID NO: 343

SEQ ID NO: 362 - protein, 374 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 363 - protein, 94 aa, Homo sapiens
MSVKGMAIALAVILCATVVQGFPMFKRGRCLCIGPGVKAVKVADIEKASIMYPSNNCDKIEVIITLKENKGQRCLNPKSKQARLIIKKVERKNF

SEQ ID NO: 364 - protein, 92 aa, Homo sapiens
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 365 - protein, 180 aa, Homo sapiens
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 366 - protein, 1192 aa, Homo sapiens [sequence omitted]

SEQ ID NO: 367 - protein, 373 aa, Homo sapiens
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 368 - protein, 199 aa, Homo sapiens
MDGQKKNWKDKVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 369 - protein, 473 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 370 - protein, 317 aa, Homo sapiens
MAKNPPENCEDCHILNAEAFKSKKICKSLKICGLVFGILALTLIVLFWGSKHFWPEVPKKAYDMEHTFYSNGEKKKIYMEIDPVTRTEIFRSGNGTDETLEVHDFKNGYTGIYFVGLQKCFIKTQIKVIPEFSEPEEEIDENEEITTTFFEQSVIWVPAEKPIENRDFLKNSKILEICDNVTMYWINPTLISVSELQDFEEEGEDLHFPANEKKGIEQNEQWVVPQVKVEKTRHARQASEEELPINDYTENGIEFDPMLDERGYCCIYCRRGNRYCRRVCEPLLGYYPYPYCYQGGRVICRVIMPCNWWVARMLGRV

SEQ ID NO: 371 - protein, 164 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKYVGARCCLMPWSLPGPQCDKPRR

SEQ ID NO: 372 - protein, 188 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPQCDKPRR

SEQ ID NO: 373 - protein, 208 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKYVGARCCLMPWSLPGPHPCGPCSERRKHLFVQDPQTCKCSCKNTDSRCKARQLELNERTCRCDKPRR

SEQ ID NO: 374 - protein, 354 aa, Homo sapiens
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 375 - protein, 160 aa, Homo sapiens; identical to SEQ ID NO: 234

SEQ ID NO: 376 - protein, 182 aa, Homo sapiens; identical to SEQ ID NO: 235

SEQ ID NO: 377 - protein, 258 aa, Homo sapiens; identical to SEQ ID NO: 236

SEQ ID NO: 378 - protein, 355 aa, Homo sapiens
MDYTLDLSVTTVTDYYYPDIFSSPCDAELIQTNGKLLLAVFYCLLFVFSLLGNSLVILVLEVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSNVDYIL

SEQ ID NO: 379 - protein, 355 aa, Homo sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 380 - protein, 92 aa, Homo sapiens; identical to SEQ ID NO: 364

SEQ ID NO: 381 - protein, 93 aa, Homo sapiens
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 382 - protein, 211 aa, Homo sapiens [sequence omitted]

SEQ ID NO: 383 - protein, 196 aa, Homo sapiens; identical to SEQ ID NO: 123

SEQ ID NO: 384 - protein, 271 aa, Homo sapiens
MLLTSSLHHPRHQMSPGSWKKLIILLSCVFGGGGTSLQNKNPHQPMTLTWQGDPIPEELYKMLSGHSIRSFNDLQRLLQGDSGKEDGAELDLNMTRSHSGGELESLARGKRSLGSLSVAEPAMIAECKTRTEVFEISRRLIDRTNANFLVWPPCVEVQRCSGCCNNRNVQCRPTQVQLRPVQVRKIEIVRKKPIFKKATVTLEDHLACKCEIVAAARAVTRSPGTSQEQRAKTTQSRVTIRTVRVRRPPKGKHRKCKHTHDKTALKETLGA

SEQ ID NO: 385 - protein, 11 aa, Homo sapiens
RPKPQQFFGLM

SEQ ID NO: 386 - protein, 153 aa, Homo sapiens
APVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 387 - protein, 144 aa, Homo sapiens; identical to SEQ ID NO: 279

SEQ ID NO: 388 - protein, 144 aa, Homo sapiens
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTMAGNALTFLKSLLEIFQKEKMRGMRGKI

SEQ ID NO: 389 - protein, 126 aa, Homo sapiens
QGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 390 - protein, 126 aa, Homo sapiens
QGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTMAGNALTFLKSLLEIFQKEKMRGMRGKI

SEQ ID NO: 391 - protein, 261 aa, Homo sapiens
MLQAEAVQSPCGRKEHAECKTERRPEAGTHKREETGGNLRRESWGMVGRVRPEPGRPLRAMGKGPWTPSLGPDRDLALPPLTCGFPPQLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 392 - protein, 180 aa, Homo sapiens
MDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 393 - protein, 662 aa, Homo sapiens; identical to SEQ ID NO: 302

SEQ ID NO: 394 - protein, 862 aa, Homo sapiens; identical to SEQ ID NO: 301

SEQ ID NO: 395 - protein, 396 aa, Homo sapiens
MEFLKTCVLRRNACTAVCFWRSKVVQKPSVRRISTTSPRSTVMPAWVIDKYGKNEVLRFTQNMMMPIIHYPNEVIVKVHAASVNPIDVNMRSGYGATALNMKRDPLHVKIKGEEFPLTLGRDVSGVVMECGLDVKYFKPGDEVWAAVPPWKQGTLSEFVVVSGNEVSHKPKSLTHTQAASLPYVALTAWSAINKVGGLNDKNCTGKRVLILGASGGVGTFAIQVMKAWDAHVTAVCSQDASELVRKLGADDVIDYKSGSVEEQLKSLKPFDFILDNVGGSTETWAPDFLKKWSGATYVTLVTPFLLNMDRLGIADGMLQTGVTVGSKALKHFWKGVHYRWAFFMASGPCLDDIAELVDAGKIRPVIEQTFPFSKVPEAFLKVERGHARGKTVINVV

SEQ ID NO: 396 - protein, 570 aa, Homo sapiens
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVTQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGIVTDETLSFIQKSRRLLVVLSPNYVLQGTQALLELKAGLENMGSRGNINVILVQYKAVKETKVKELKRAKTVLTVIKWKGEKSKYPQGRFWKQLQVAMPVKKSPRRSSSDEQGLSYSSLKNV

SEQ ID NO: 397 - protein, 357 aa, Homo sapiens
MTLLWCWSLYFYGILQSDASERCDDWGLDTHRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEWQKDSCFNSPMKLPVHKLYIEYGIQRITCPNVDGYFPSSVKPTITNYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVTQKVPAPRYTVE

SEQ ID NO: 398 - protein, 562 aa, Homo sapiens [sequence omitted]

SEQ ID NO: 399 - protein, 561 aa, Homo sapiens
MGMPPLLFCWVSFVLPLFVAAGNCTDVYMHHEMISEGQPFPFNCTYPPVTNGAVNLTWHRTPSKSPISINRHVRIHQDQSWILFLPLALEDSGIYQCVIKDAHSCYRIAINLTVFRKHWCDSSNEESSINSSDEYQQWLPIGKSGSLTCHLYFPESCVLDSIKWYKGCEEIKVSKKFCPTGTKLLVNNIDVEDSGSYACSARLTHLGRIFTVRNYIAVNTKEVGSGGRIPNITYPKNNSIEVQLGSTLIVDCNITDTKENTNLRCWRVNNTLVDDYYNDFKRIQEGIETNLSLRNHILYTVNITFLEVKMEDYGHPFTCHAAVSAAYIILKRPAPDFRAYLIGGLMAFLLLAVSILYIYNTFKVDIVLWYRSTFHTAQAPDDEKLYDAYVLYPKYPRESQGHDVDTLVLKILPEVLEKQCGYKLFIFGRDEFPGQAVASVIDENIKLCRRLMVLVAPETSSFSFLKNLTEEQIAVYNALVQDGMKVILIELERVKDYSTMPESIQYIRQKHGAIQWDGDFTEQAQCAKTKFWKKVRYHMPPRRYPASPPVQLLGHTPRIPG

SEQ ID NO: 400 - protein, 380 aa, Homo sapiens; identical to SEQ ID NO: 299

SEQ ID NO: 401 - protein, 137 aa, Homo sapiens
MKVSVAALSCLMLVTALGSQARVTKDAETEFMMSKLPLENPVLLDMLWRRKIGPQMTLSHAAGFHATSADCCISYTPRSIPCSLLESYFETNSECSKPGVIFLTKKGRRFCANPSDKQVQVCMRMLKLDTRIKTRKN

SEQ ID NO: 402 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKKGRKACLNPASPIVKKIIKKLLES

SEQ ID NO: 403 - protein, 73 aa, Homo sapiens
MSAKDLQCQCIKTYSKPFHPKFIKELRVIESGPHCANTEIIVKLSDGRELCLDPKENWVQRVVEKFLKRAENS

SEQ ID NO: 404 - protein, 73 aa, Homo sapiens
MSAKELQCQCIKTYSKPFHPKFIKELRVIESGPHCANTEIIVKLSDGRELCLDPKENWVQRVVEKFLKRAENS

SEQ ID NO: 405 - protein, 98 aa, Homo sapiens; identical to SEQ ID NO: 249

SEQ ID NO: 406 - protein, 120 aa, Homo sapiens
MKVSEAALSLLVLILIITSASRSQPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 407 - protein, 96 aa, Homo sapiens; identical to SEQ ID NO: 248

SEQ ID NO: 408 - protein, 93 aa, Homo sapiens; identical to SEQ ID NO: 343

SEQ ID NO: 409 - protein, 109 aa, Homo sapiens
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 410 - protein, 93 aa, Homo sapiens
MGLSLASAVLLASLLSLHLGTATRGSDISKTCCFQYLGTATRGSDISKTCCFQYSCSQRAVIFTTKRGKKVCTHPRKKWVQKYISLLKTPKQL

SEQ ID NO: 411 - protein, 111 aa, Homo sapiens
MAPISLSWLLRLATFCHLTVLLAGQHHGVTKCNITCSKMTSKIPVALLIHYQQNQASCGKRAIILETRQHRLFCADPKEQWVKDAMQHLDRQAAALTPKWRHLPKKPDRRG

SEQ ID NO: 412 - protein, 113 aa, Homo sapiens; identical to SEQ ID NO: 342

SEQ ID NO: 413 - protein, 150 aa, Homo sapiens [sequence omitted]

SEQ ID NO: 414 - protein, 120 aa, Homo sapiens; identical to SEQ ID NO: 406

SEQ ID NO: 415 - protein, 95 aa, Homo sapiens
MSVKGMAIALAVILCATVVQGFPMFKRGRCLCIGPGVKAVKVADIEKASIMYPSNNCDKIEVIITLKEIRKRCLTPNRASKQARLIIKKAERKNF

SEQ ID NO: 416 - protein, 127 aa, Homo sapiens
MQQRGLAIVALAVCAALHASEAILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 417 - protein, 112 aa, Homo sapiens
MKGPPTFCSLLLLSLLLSPDPTAAFLLPPSTACCTQLYRKPLSDKLLRKVIQVELQEADGDCHLQAFVLHLAQRSICIHPQNPSLSQWFEHQERKLHGTLPKLNFGMLRKMG

SEQ ID NO: 418 - protein, 42 aa, Homo sapiens
RFEGYRPNLAESCPCRQYRAYVLTHSGELYERPERSDRQICV

SEQ ID NO: 419 - protein, 134 aa, Homo sapiens; identical to SEQ ID NO: 246

SEQ ID NO: 420 - protein, 93 aa, Homo sapiens
MARLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 421 - protein, 109 aa, Homo sapiens; identical to SEQ ID NO: 409

SEQ ID NO: 422 - protein, 93 aa, Homo sapiens; identical to SEQ ID NO: 420

SEQ ID NO: 423 - protein, 127 aa, Homo sapiens
  MOD_RES (70)..(70): Any naturally occurring amino acid
  MOD_RES (91)..(91): Any naturally occurring amino acid
MQQRGLAIVALAVCAALHASEAILPIASSCCTEVSHHISRRLLERVNMCRIQRADGDCDLAAVILHVKRXRICVSPHNHTVKQWMKVQAAXKNGKGNVCHRKKHHGKRNSNRAHQGKHETYGHKTPY

SEQ ID NO: 424 - protein, 104 aa, Homo sapiens
  MOD_RES (47)..(47): Any naturally occurring amino acid
  MOD_RES (68)..(68): Any naturally occurring amino acid
LPIASSCCTEVSHHISRRLLERVNMCRIQRADGDCDLAAVILHVKRXRICVSPHNHTVKQWMKVQAAXKNGKGNVCHRKKHHGKRNSNRAHQGKHETYGHKTPY

SEQ ID NO: 425 - protein, 69 aa, Homo sapiens
MKPVSLSYRCPCRFFESHVARANVKHLKILNTPNCALQIVARLKNNNRQVCIDPKLKWIQEYLEKALNK

SEQ ID NO: 426 - protein, 73 aa, Homo sapiens
MKPVSLSYRCPCRFFESHVARANVKHLKILNTPNCALQIVARLKNNNRQVCIDPKLKWIQEYLEKALNKRFKM

SEQ ID NO: 427 - protein, 90 aa, Homo sapiens
MAAKDVKHHHHHHGSGSDDDDKKPVSLSYRCPCRFFESHVARANVKHLKILNTPNCALQIVARLKNNNRQVCIDPKLKWIQEYLEKALNK

SEQ ID NO: 428 - protein, 94 aa, Homo sapiens
MAAKDVKHHHHHHGSGSDDDDKKPVSLSYRCPCRFFESHVARANVKHLKILNTPNCALQIVARLKNNNRQVCIDPKLKWIQEYLEKALNKRFKM

SEQ ID NO: 429 - protein, 71 aa, Homo sapiens
SIPITCCFNVINRKIPIQRLESYTRITNIQCPKEAVIFKTKRGKEVCADPKERWVRDSMKHLDQIFQNLKP

SEQ ID NO: 430 - protein, 66 aa, Homo sapiens
YSSDTTPCCFAYIARPLPRAHIKEYFYTSGKCSNPAVVFVTRKNRQVCANPEKKWVREYINSLEMS

SEQ ID NO: 431 - protein, 356 aa, Homo sapiens
MSIPLPLLQIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 432 - protein, 94 aa, Homo sapiens; identical to SEQ ID NO: 349

SEQ ID NO: 433 - protein, 93 aa, Homo sapiens; identical to SEQ ID NO: 381

SEQ ID NO: 434 - protein, 92 aa, Homo sapiens; identical to SEQ ID NO: 364

SEQ ID NO: 435 - protein, 109 aa, Homo sapiens
MKISVAAIPFFLLITIALGTKTESSSQTGGKPKVVKIQLKLVGGPYHPSECCFTYTTYKIPRQRIMDYYETNSQCSKPGIVFITKRGHSVCTNPSDKWVQDYIKDMKEN

SEQ ID NO: 436 - protein, 134 aa, Homo sapiens; identical to SEQ ID NO: 246

SEQ ID NO: 437 - protein, 145 aa, Homo sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKSQPLTPLFCPHRTERSQTPKGP

SEQ ID NO: 438 - protein, 93 aa, Homo sapiens; identical to SEQ ID NO: 381

SEQ ID NO: 439 - protein, 89 aa, Homo sapiens
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 440 - protein, 69 aa, Homo sapiens
AQVGTNKELCCLVYTSWQIPQKFIVDYSETSPQCPKPGVILLTKRGRQICADPNKKWVQKYISDLKLNA

SEQ ID NO: 441 - protein, 264 aa, Homo sapiens
MKKTAIAIAVALAGFATVANADEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQCLAARLEALKENGGARLAEYHAKATEHLSTLSEKAKPALEDLRQGLLPVLESFKVSFLSALEEYTKKLNTQ

SEQ ID NO: 442 - protein, 687 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRGEHCNKKAVFSRISKFKSTRNDCTTQSNVKH

SEQ ID NO: 443 - protein, 668 aa, Homo sapiens
SEQNMQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIAVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLER

SEQ ID NO: 444 - protein, 780 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLLI

SEQ ID NO: 445 - protein, 788 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIAVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYCQACSVLGCAKVEAFFIIEGAQEKTNLEIIILVGTTVIAMFFWLLLVIILGTV

SEQ ID NO: 446 - protein, 374 aa, Homo sapiens; identical to SEQ ID NO: 362

SEQ ID NO: 447 - protein, 360 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 448 - protein, 352 aa, Homo sapiens [sequence omitted]

SEQ ID NO: 449 - protein, 152 aa, Homo sapiens; identical to SEQ ID NO: 280

SEQ ID NO: 450 - protein, 195 aa, Homo sapiens
DSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKD

SEQ ID NO: 451 - protein, 178 aa, Homo sapiens
  MOD_RES (1)..(1): Asp or Asn
XPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKD

SEQ ID NO: 452 - protein, 86 aa, Homo sapiens
AIKKAHIEKDFIAFCSSTPDNVSWRHPTMGSVFIGRLIEHMQEYACSCDVEEIFRKVRFSFEQPGRAQMPTTERVTTRCFYLFPGH

SEQ ID NO: 453 - protein, 267 aa, Homo sapiens; identical to SEQ ID NO: 313

SEQ ID NO: 454 - protein, 208 aa, Homo sapiens
MTHLSLLGPLPCVRTSQQLPETQQVTTPGKKPVSVGRREVRVPGTALVPSLLSVSVSPAAPQYQGSPFSDPGFSAPELQLSSLPPATAFFKTWHALDDGERLSPRGPLTQHLQLVEDDQSDLNPGSPILPAQLGAARLRAQGPLGNMAAIMTALGLPIPPEEDTPGLAAFGASAFERKCRGYVVTREYGHWTDRAVRDLALLKAKYSA

SEQ ID NO: 455 - protein, 208 aa, Homo sapiens [sequence omitted]

SEQ ID NO: 456 - protein, 109 aa, Homo sapiens
MLKLTPLPSKMKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 457 - protein, 122 aa, Homo sapiens
MKPFHTALSFLILTTALGIWAQITHATETKEVQSSLKAQQGLEIEMFHMGFQDSSDCCLSYNSRIQCSRFIGYFPTSGGCTRPGIIFISKRGFQVCANPSDRRVQRCIERLEQNSQPRTYKQ

SEQ ID NO: 458 - protein, 131 aa, Homo sapiens
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDKWDFYCQ

SEQ ID NO: 459 - protein, 120 aa, Homo sapiens
MKVSVAALSCLMLVTALGSQARVTKDAETEFMMSKLPLENPVLLDRFHATSADCCISYTPRSIPCSLLESYFETNSECSKPGVIFLTKKGRRFCANPSDKQVQVCVRMLKLDTRIKTRKN

SEQ ID NO: 460 - protein, 114 aa, Homo sapiens
MRLLILALLGICSLTAYIVEGVGSEVSHRRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 461 - protein, 1255 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 462 - protein, 478 aa, Human immunodeficiency virus
KLWVTVYYGVPVWKEATTTLFCASDARAYDTEVHNVWATHACVPTDPNPQEVVLGNVTENFNMWKNNMVEQMQEDIISLWDQSLKPCVKLTPLCVTLNCTDLGKATNTNSSNWKEEIKGEIKNCSFNITTSIRDKIQKENALFRNLDVVPIDNASTTTNYTNYRLIHCNRSVITQACPKVSFEPIPIHYCTPAGFAILKCNNKTFNGKGPCTNVSTVQCTHGIRPIVSTQLLLNGSLAEEEVVIRSDNFTNNAKTIIVQLNESVAINCTRPNNNTRKSIYIGPGRAFHTTGRIIGDIRKAHCNISRAQWNNTLEQIVKKLREQFGNNKTIVFNQSSGGDPEIVMHSFNCRGEFFYCNTTQLFNNTWRLNHTEGTKGNDTIILPCRIKQIINMWQEVGKAMYAPPIGGQISCSSNITGLLLTRDGGTNVTNDTEVFRPGGGDMRDNWRSELYKYKVIKIEPLGIAPTKAKRRVVQREKR

SEQ ID NO: 463 - protein, 94 aa, Homo sapiens; identical to SEQ ID NO: 363

SEQ ID NO: 464 - protein, 477 aa, Homo sapiens
LEHDNPEDDKVYFFFRENAIDGEHSGKATHARIGQICKNDFGGHRSLVNKWTTFLKARLICSVPGPNGIDTHFDELQDVFLMNFKDPKNPVVYGVFTTSSNIFKGSAVCMYSMSDVRRVFLGPYAHRDGPNYQWVPYQGRVPYPRPGTCPSKTFGGFDSTKDLPDDVITFARSHPAMYNPVFPMNNRPIVIKTDVNYQFTQIVVDRVDAEDGQYDVMFIGTDVGTVLKVVSIPKETWYDLEEVLLEEMTVFREPTAISAMELSTKQQQLYIGSTAGVAQLPLHRCDIYGKACAECCLARDPYCAWDGSACSRYFPTAKRRTRRQDIRNGDPLTHCSDLHHDNHHGHSPEERIIYGVENSSTFLECSPKSQRALVYWQFQRRNEERKEEIRVDDHIIRTDQGLLLRSLQQKDSGNYLCHAVEHGFIQTLLKVTLEVIDNEHLEELLHKDDDGHGSKTKEMSNSMTPSQKVWYRDFMQP

SEQ ID NO: 465 - protein, 241 aa, Homo sapiens; identical to SEQ ID NO: 254

SEQ ID NO: 466 - protein, 267 aa, Homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 467 - DNA, 20 bp, Artificial Sequence
  Description of Artificial Sequence: Synthetic oligonucleotide
tgagcagaagtggctcagtg

SEQ ID NO: 468 - DNA, 20 bp, Artificial Sequence
  Description of Artificial Sequence: Synthetic oligonucleotide
tggctgtacagctacacccc

SEQ ID NO: 469 - DNA, 20 bp, Artificial Sequence
  Description of Artificial Sequence: Synthetic oligonucleotide
ttccactcctgcagggcccc

SEQ ID NO: 470 - DNA, 20 bp, Artificial Sequence
  Description of Artificial Sequence: Synthetic oligonucleotide
tcgcccttcagcccgcgttc

SEQ ID NO: 471 - protein, 7 aa, Homo sapiens
PKKKRKV

SEQ ID NO: 472 - protein, 16 aa, Homo sapiens
LGRVIPRKIASRASLM

SEQ ID NO: 473 - DNA, 20 bp, Artificial Sequence
  Description of Artificial Sequence: Synthetic oligonucleotide
tgagcagaagtggctcagtg

SEQ ID NO: 474 - DNA, 20 bp, Artificial Sequence
  Description of Artificial Sequence: Synthetic oligonucleotide
tcggccgccgccaagctcgt

SEQ ID NO: 475 - DNA, 20 bp, Artificial Sequence
  Description of Artificial Sequence: Synthetic oligonucleotide
tgcgcgcagcctggtaggag

SEQ ID NO: 476 - DNA, 24 bp, Artificial Sequence
  Description of Artificial Sequence: Synthetic oligonucleotide
taactcaagactgcctcccgcttt

SEQ ID NO: 477 - DNA, 24 bp, Artificial Sequence
  Description of Artificial Sequence: Synthetic oligonucleotide
agcccaaggtttcagaggtgatga

SEQ ID NO: 478 - DNA, 21 bp, Artificial Sequence
  Description of Artificial Sequence: Synthetic oligonucleotide
gcatctgccctgcgggagatc

SEQ ID NO: 479 - DNA, 26 bp, Artificial Sequence
  Description of Artificial Sequence: Synthetic oligonucleotide
ccacgttctcctttctctccccgttc

SEQ ID NO: 480 - DNA, 6 bp, Artificial Sequence
  Description of Artificial Sequence: Synthetic oligonucleotide
acgcgt

SEQ ID NO: 481 - DNA, 21 bp, Artificial Sequence
  Description of Artificial Sequence: Synthetic oligonucleotide
gcatctgccctgcgggagatc

SEQ ID NO: 482 - DNA, 26 bp, Artificial Sequence
  Description of Artificial Sequence: Synthetic oligonucleotide
ccacgttctcctttctctccccgttc

SEQ ID NO: 483 - DNA, 32 bp, Artificial Sequence
  Description of Artificial Sequence: Synthetic oligonucleotide
aaaaaaaccggttcattttctcttccggccac

SEQ ID NO: 484 - DNA, 27 bp, Artificial Sequence
  Description of Artificial Sequence: Synthetic oligonucleotide
aaaaaagctagcatggcgggtctgacg

SEQ ID NO: 485 - DNA, 32 bp, Artificial Sequence; identical to SEQ ID NO: 483
  Description of Artificial Sequence: Synthetic oligonucleotide

SEQ ID NO: 486 - protein, 786 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGPQAAVPGVPGTGGVPGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 487 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPTGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 488 - protein, 1366 aa, Homo sapiens; identical to SEQ ID NO: 62

SEQ ID NO: 489 - protein, 1466 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 490 - protein, 2944 aa, Homo sapiens; identical to SEQ ID NO: 78

SEQ ID NO: 491 - protein, 529 aa, Homo sapiens [sequence omitted]

SEQ ID NO: 492 - protein, 1669 aa, Homo sapiens; identical to SEQ ID NO: 66

SEQ ID NO: 493 - protein, 1712 aa, Homo sapiens; identical to SEQ ID NO: 67

SEQ ID NO: 494 - protein, 1670 aa, Homo sapiens; identical to SEQ ID NO: 68

SEQ ID NO: 495 - protein, 1690 aa, Homo sapiens; identical to SEQ ID NO: 69

SEQ ID NO: 496 - protein, 1685 aa, Homo sapiens; identical to SEQ ID NO: 70

SEQ ID NO: 497 - protein, 1691 aa, Homo sapiens; identical to SEQ ID NO: 71

SEQ ID NO: 498 - protein, 2944 aa, Homo sapiens; identical to SEQ ID NO: 78

SEQ ID NO: 499 - protein, 1838 aa, Homo sapiens; identical to SEQ ID NO: 72

SEQ ID NO: 500 - protein, 1499 aa, Homo sapiens; identical to SEQ ID NO: 73

SEQ ID NO: 501 - protein, 1745 aa, Homo sapiens; identical to SEQ ID NO: 74

SEQ ID NO: 502 - protein, 824 aa, Homo sapiens; identical to SEQ ID NO: 145

SEQ ID NO: 503 - protein, 423 aa, Homo sapiens; identical to SEQ ID NO: 151

SEQ ID NO: 504 - protein, 307 aa, Homo sapiens; identical to SEQ ID NO: 162

SEQ ID NO: 505 - protein, 1118 aa, Homo sapiens
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 506 - protein, 747 aa, Homo sapiens; identical to SEQ ID NO: 160

SEQ ID NO: 507 - protein, 713 aa, Homo sapiens; identical to SEQ ID NO: 147

SEQ ID NO: 508 - protein, 115 aa, Homo sapiens
MIPAKDMAKVMIVMLAICFLTKSDGKSVKKRSVSEIQLMHNLGKHLNSMERVEWLRKKLQDVHNFVALGAPLAPRDAGSQRPRKKEDNVLVESHEKSLGEADKADVNVLTKAKSQ

SEQ ID NO: 509 - protein, 730 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSEKRPALQPPRGRPHQLKFRVQKRNRTPQ

SEQ ID NO: 510 - protein, 302 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGVLHSSLLLLSCGSRNGASFPCSLESSTHQALCWTGLFLRPSPFPRLPLAAPRTLRAGV

SEQ ID NO: 511 - protein, 622 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEGCYDLQVGKPLLWDRHCFRLSTHGPEMLGTALRG

SEQ ID NO: 512 - protein, 717 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSGGELFGLLGHPPRRP

SEQ ID NO: 513 - protein, 823 aa, Homo sapiens
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSVLEGAGDRHSHLSGLELLLCPHALVDTVPAPPSALHGDTHAHTHTHVHTHCPIAQETCRGPPLGASRLSPQGPGHLTLAPQEGSYLDFWDTHRGDPKPRRRRKSLKTFSLTPATFRGIWAL

SEQ ID NO: 514 - protein, 472 aa, Homo sapiens
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQLLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 515 - protein, 417 aa, Homo sapiens
MHLTVFLLKGIVGFLWSCWVLVGYAKGGLGDNHVHSSFIYRRLRNHERREIQREILSILGLPHRPRPFSPGKQASSAPLFMLDLYNAMTNEENPEESEYSVRASLAEETRGARKGYPASPNGYPRRIQLSRTTPLTTQSPPLASLHDTNFLNDADMVMSFVNLVERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGDYNTSEQKQACKKHELYVSFRDLGWQVHLMFPDHVPKPCCAPTKLNAISVLYFDDSSNVILKKYRNMVVRSCGCH

SEQ ID NO: 516 - protein, 475 aa, Homo sapiens
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 517 - protein, 499 aa, Homo sapiens
MDTSPLCFSILLVLCIFIQSSALGQSLKPEPFGRRAQAVETNKTLHEMKTRFLLFGETNQGCQIRINHPDTLQECGFNSSLPLVMIIHGWSVDGVLENWIWQMVAALKSQPAQPVNVGLVDWITLAHDHYTIAVRNTRLVGKEVAALLRWLEESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 518 - protein, 465 aa, Homo sapiens
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 519 - protein, 500 aa, Homo sapiens
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 520 - protein, 399 aa, Homo sapiens
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 521 - protein, 1076 aa, Homo sapiens
MEPGSKSVSRSDWQPEPHQRPITPLEPGPEKTPIAQPESKTLQGSNTQQKPASNQRPLTQQETPAQHDAESQKEPRAQQKSASQEEFLAPQKPAPQQSPYIQRVLLTQQEAASQQGPGLGKESITQQEPALRQRHVAQPGPGPGEPPPAQQEAESTPAAQAKPGAKREPSAPTESTSQETPEQSDKQTTPVQGAKSKQGSLTELGFLTKLQELSIQRSALEWKALSEWVTDSESESDVGSSSDTDSPATMGGMVAQGVKLGFKGKSGYKVMSGYSGTSPHEKTSARNHRHYQDTASRLIHNMDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFTSGRFAIDPELRGAEFERITQNLDVHFWKAFWNITEMEVLSSLANMASATVRVSRLLSLPPEAFEMPLTADPTLTVTISPPLAHTGPGPVLVRLISYDLREGQDSEELSSLIKSNGQRSLELWPRPQQAPRSRSLIVHFHGGGFVAQTSRSHEPYLKSWAQELGAPIISIDYSLAPEAPFPRALEECFFAYCWAIKHCALLGSTGERICLAGDSAGGNLCFTVALRAAAYGVRVPDGIMAAYPATMLQPAASPSRLLSLMDPLLPLSVLSKCVSAYAGAKTEDHSNSDQKALGMMGLVRRDTALLLRDFRLGASSWLNSFLELSGRKSQKMSEPIAEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVMLARRLRNLGQPVTLRVVEDLPHGFLTLAALCRETRQAAELCVERIRLVLTPPAGAGPSGETGAAGVDGGCGGRH

SEQ ID NO: 522 - protein, 398 aa, Homo sapiens
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 523 - protein, 467 aa, Homo sapiens
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCICVDWKKGSQATYTQAANNVRVVGAQVAQMLDILLTEYSYPPSKVHLIGHSLGAHVAGEAGSKTPGLSRITGLDPVEASFESTPEEVRLDPSDADFVDVIHTDAAPLIPFLGFGTNQQMGHLDFFPNGGESMPGCKKNALSQIVDLDGIWAGTRDFVACNHLRSYKYYLESILNPDGFAAYPCTSYKSFESDKCFPCPDQGCPQMGHYADKFAGRTSEEQQKFFLNTGEASNFARWRYGVSITLSGRTATGQIKVALFGNKGNTHQYSIFRGILKPGSTHSYEFDAKLDVGTIEKVKFLWNNNVINPTLPKVGATKITVQKGEEKTVYNFCSEDTVREDTLLTLTPC

SEQ ID NO: 524 - protein, 469 aa, Homo sapiens
MLPPWTLGLLLLATVRGKEVCYGQLGCFSDEKPWAGTLQRPVKLLPWSPEDIDTRFLLYTNENPNNFQLITGTEPDTIEASNFQLDRKTRFIIHGFLDKAEDSWPSDMCKKMFEVEKVNCICVDWRHGSRAMYTQAVQNIRVVGAETAFLIQALSTQLGYSLEDVHVIGHSLGAHTAAEAGRRLGGRVGRITGLDPAGPCFQDEPEEVRLDPSDAVFVDVIHTDSSPIVPSLGFGMSQKVGHLDFFPNGGKEMPGCKKNVLSTITDIDGIWEGIGGFVSCNHLRSFEYYSSSVLNPDGFLGYPCASYDEFQESKCFPCPAEGCPKMGHYADQFKGKTSAVEQTFFLNTGESGNFTSWRYKVSVTLSGKEKVNGYIRIALYGSNENSKQYEIFKGSLKPDASHTCAIDVDFNVGKIQKVKFLWNKRGINLSEPKLGASQITVQSGEDGTEYNFCSSDTVEENVLQSLYPC

SEQ ID NO: 525 - protein, 753 aa, Homo sapiens
MGRLQLVVLGLTCCWAVASAAKLGAVYTEGGFVEGVNKKLGLLGDSVDIFKGIPFAAPTKALENPQPHPGWQGTLKAKNFKKRCLQATITQDSTYGDEDCLYLNIWVPQGRKQVSRDLPVMIWIYGGAFLMGSGHGANFLNNYLYDGEEIATRGNVIVVTFNYRVGPLGFLSTGDANLPGNYGLRDQHMAIAWVKRNIAAFGGDPNNITLFGESAGGASVSLQTLSPYNKGLIRRAISQSGVALSPWVIQKNPLFWAKKVAEKVGCPVGDAARMAQCLKVTDPRALTLAYKVPLAGLEYPMLHYVGFVPVIDGDFIPADPINLYANAADIDYIAGTNNMDGHIFASIDMPAINKGNKKVTEEDFYKLVSEFTITKGLRGAKTTFDVYTESWAQDPSQENKKKTVVDFETDVLFLVPTEIALAQHRANAKSAKTYAYLFSHPSRMPVYPKWVGADHADDIQYVFGKPFATPTGYRPQDRTVSKAMIAYWTNFAKTGDPNMGDSAVPTHWEPYTTENSGYLEITKKMGSSSMKRSLRTNFLRYWTLTYLALPTVTDQEATPVPPTGDSEATPVPPTGDSETAPVPPTGDSGAPPVPPTGDSGAPPVPPTGDSGAPPVPPTGDSGAPPVPPTGDSGAPPVPPTGDSGAPPVPPTGDSGAPPVPPTGDSGAPPVPPTGDAGPPPVPPTGDSGAPPVPPTGDSGAPPVTPTGDSETAPVPPTGDSGAPPVPPTGDSEAAPVPPTDDSKEAQMPAVIRF

SEQ ID NO: 526 - protein, 13 aa, Homo sapiens
SYSMEHFRWGKPV

SEQ ID NO: 527 - protein, 18 aa, Homo sapiens
DEGPYRMEHFRWGSPPKD

SEQ ID NO: 528 - protein, 11 aa, Homo sapiens
YVMGHFRWDRF

SEQ ID NO: 529 - protein, 267 aa, Homo sapiens; identical to SEQ ID NO: 158

SEQ ID NO: 530 - protein, 189 aa, Homo sapiens
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 531 - protein, 188 aa, Homo sapiens [sequence omitted]

SEQ ID NO: 532 - protein, 189 aa, Homo sapiens
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 533 - protein, 189 aa, Homo sapiens
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 534 - protein, 189 aa, Homo sapiens
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 535 - protein, 189 aa, Homo sapiens
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 536 - protein, 189 aa, Homo sapiens
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 537 - protein, 189 aa, Homo sapiens
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 538 - protein, 189 aa, Homo sapiens
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 539 - protein, 189 aa, Homo sapiens
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 540 - protein, 189 aa, Homo sapiens
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 541 - protein, 189 aa, Homo sapiens
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 542 - protein, 166 aa, Homo sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 543 - protein, 187 aa, Homo sapiens
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 544 - protein, 207 aa, Homo sapiens
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHTFKYWKERHLKQIQIGLDQQAEYLNQCLEEDKNENEDMKEMKENEMKPSEARVPQLSSLELRRYFHRIDNFLKEKKYSDCAWEIVRVEIRRCLYYFYKFTALFRRK

SEQ ID NO: 545 - protein, 208 aa, Homo sapiens
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 546 - protein, 4 aa, Homo sapiens
EYFY

SEQ ID NO: 547 - protein, 4 aa, Homo sapiens
GHGG

SEQ ID NO: 548 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 549 - protein, 136 aa, Homo sapiens [sequence omitted]

SEQ ID NO: 550 - protein, 135 aa, Homo sapiens
MYRMQLLSCIALSLALVTNSANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 551 - protein, 153 aa, Homo sapiens
MYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 552 - protein, 162 aa, Homo sapiens
MNSFSTSAFGPVAFSLGLLLVLPAAFPAPGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 553 - protein, 166 aa, Homo sapiens
MAALQKSVSSFLMGTLATSCLLLLALLVQGGAAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 554 - protein, 179 aa, Homo sapiens
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 555 - protein, 155 aa, Homo sapiens; identical to SEQ ID NO: 106

SEQ ID NO: 556 - protein, 135 aa, Homo sapiens
MGNYKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 557 - protein, 153 aa, Homo sapiens
MTNKCLLQIALLLCFSTTALSMKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 558 - protein, 211 aa, Homo sapiens
MRSGCVVVHVWILAGLWLAVAGRDSSPLVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 559 - protein, 209 aa, Homo sapiens
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 560 - protein, 251 aa, Homo sapiens
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 561 - protein, 247 aa, Homo sapiens
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 562 - protein, 379 aa, Homo sapiens
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKLHEWTKPENLDFIEVNVSLPRFKLEESYTLNSDLARLGVQDLFNSSKADLSGMSGARDIFISKIVHKSFVEVNEEGTEAAAATAGIATFCMLMPEENFTADHPFLFFIRHNSSGSILFLGRFSSP

SEQ ID NO: 563 - protein, 404 aa, Homo sapiens
MADKVLKEKRKLFIRSMGEGTINGLLDELLQTRVLNKEEMEKVKRENATVMDKTRALIDSVIPKGAQACQICITYICEEDSYLAGTLGLSADQTSGNYLNMQDSQGVLSSFPAPQAVQDNPAMPTSSGSEGNVKLCSLEEAQRIWKQKSAEIYPIMDKSSRTRLALIICNEEFDSIPRRTGAEVDITGMTMLLQNLGYSVDVKKNLTASDMTTELEAFAHRPEHKTSDSTFLVFMSHGIREGICGKKHSEQVPDILQLNAIFNMLNTKNCPSLKDKPKVIIIQACRGDSPGVVWFKDSVGVSGNLSLPTTEEFEDDAIKKAHIEKDFIAFCSSTPDNVSWRHPTMGSVFIGRLIEHMQEYACSCDVEEIFRKVRFSFEQPDGRAQMPTTERVTLTRCFYLFPGH

SEQ ID NO: 564 - protein, 202 aa, Homo sapiens
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 565 - protein, 161 aa, Homo sapiens
MDSDETGFEHSGLWVSVLAGLLLGACQAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 566 - protein, 154 aa, Homo sapiens
MTNKCLLQIALLLCFSTTALSMKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 567 - protein, 753 aa, Homo sapiens
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 568 - protein, 638 aa, Homo sapiens
MKGGCVSQWKAAAGFLFCVMVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 569 - protein, 794 aa, Homo sapiens; identical to SEQ ID NO: 189

SEQ ID NO: 570 - protein, 715 aa, Homo sapiens
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPE

SEQ ID NO: 571 - protein, 755 aa, Homo sapiens
MRPAPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRHGTRCAGEVAAMANNGFCGVGVAFNARIGGVRMLDGTITDVIEAQSLSLQPQHIHIYSASWGPEDDGRTVDGPGILTREAFRRGVTKGRGGLGTLFIWASGNGGLHYDNCNCDGYTNSIHTLSVGSTTQQGRVPWYSEACASTLTTTYSSGVATDPQIVTTDLHHGCTDQHTGTSASAPLAAGMIALALEANPFLTWRDMQHLVVRASKPAHLQAEDWRTNGVGRQVSHHYGYGLLDAGLLVDTARTWLPTQPQRKCAVRVQSRPTPILPLIYIRENVSACAGLHNSIRSLEHVQAQLTLSYSRRGDLEISLTSPMGTRSTLVAIRPLDVSTEGYNNWVFMSTHFWDENPQGVWTLGLENKGYYFNTGTLYRYTLLLYGTAEDMTARPTGPQVTSSACVQRDTEGLCQACDGPAYILGQLCLAYCPPRFFNHTRLVTAGPGHTAAPALRVCSSCHASCYTCRGGSPRDCTSCPPSSTLDQQQGSCMGPTTPDSRPRLRAAACPHHRCPASAMVLSLLAVTLGGPVLCGMSMDLPLYAWLSRARATPTKPQVWLPAGT

SEQ ID NO: 572 - protein, 1860 aa, Homo sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 573 - protein, 969 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 574 - protein, 785 aa, Homo sapiens
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 575 - protein, 1052 aa, Homo sapiens
MKLVNIWLLLLVVLLCGKKHLGDRLEKKSFEKAPCPGCSHLTLKVEFSSTVVEYEYIVAFNGYFTAKARNSFISSALKSSEVDNWRIIPRNNPSSDYPSDFEVIQIKEKQKAGLLTLEDHPNIKRVTPQRKVFRSLKYAESDPTVPCNETRWSQKWQSSRPLRRASLSLGSGFWHATGRHSSRRLLRAIPRQVAQTLQADVLWQMGYTGANVRVAVFDTGLSEKHPHFKNVKERTNWTNERTLDDGLGHGTFVAGVIASMRECQGFAPDAELHIFRVFTNNQVSYTSWFLDAFNYAILKKIDVLNLSIGGPDFMDHPFVDKVWELTANNVIMVSAIGNDGPLYGTLNNPADQMDVIGVGGIDFEDNIARFSSRGMTTWELPGGYGRMKPDIVTYGAGVRGSGVKGGCRALSGTSVASPVVAGAVTLLVSTVQKRELVNPASMKQALIASARRLPGVNMFEQGHGKLDLLRAYQILNSYKPQASLSPSYIDLTECPYMWPYCSQPIYYGGMPTVVNVTILNGMGVTGRIVDKPDWQPYLPQNGDNIEVAFSYSSVLWPWSGYLAISISVTKKAASWEGIAQGHVMITVASPAETESKNGAEQTSTVKLPIKVKIIPTPPRSKRVLWDQYHNLRYPPGYFPRDNLRMKNDPLDWNGDHIHTNFRDMYQHLRSMGYFVEVLGAPFTCFDASQYGTLLMVDSEEEYFPEEIAKLRRDVDNGLSLVIFSDWYNTSVMRKVKFYDENTRQWWMPDTGGANIPALNELLSVWNMGFSDGLYEGEFTLANHDMYYASGCSIAKFPEDGVVITQTFKDQGLEVLKQETAVVENVPILGLYQIPAEGGGRIVLYGDSNCLDDSHRQKDCFWLLDALLQYTSYGVTPPSLSHSGNRQRPPSGAGSVTPERMEGNHLHRYSKVLEAHLGDPKPRPLPACPRLSWAKPQPLNETAPSNLWKHQKLLSIDLDKVVLPNFRSNRPQVRPLSPGESGAWDIPGGIMPGRYNQEVGQTIPVFAFLGAMVVLAFFVVQINKAKSRPKRRKPRVKRPQLMQQVHPPKTPSV

SEQ ID NO: 576 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAVARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEGAVTAVAICCRSRHLAQASQELQ

SEQ ID NO: 577 - protein, 519 aa, Homo sapiens
MIPVSLVVVVVGGWTVVYLTDLVLKSSVYFKHSYEDWLENNGLSISPFHIRWQTAVFNRAFYSWGRRKARMLYQWFNFGMVFGVIAMFSSFFLLGKTLMQTLAQMMADSPSSYSSSSSSSSSSSSSSSSSSSSSSSLHNEQVLQVVVPGINLPVNQLTYFFTAVLISGVVHEIGHGIAAIREQVRFNGFGIFLFIIYPGAFVDLFTTHLQLISPVQQLRIFCAGIWHNFVLALLGILALVLLPVILLPFYYTGVGVLITEVAEDSPAIGPRGLFVGDLVTHLQDCPVTNVQDWNECLDTIAYEPQIGYCISASTLQQLSFPVRAYKRLDGSTECCNNHSLTDVCFSYRNNFNKRLHTCLPARKAVEATQVCRTNKDCKKSSSSSFCIIPSLETHTRLIKVKHPPQIDMLYVGHPLHLHYTVSITSFIPRFNFLSIDLPVVVETFVKYLISLSGALAIVNAVPCFALDGQWILNSFLDATLTSVIGDNDVKDLIGFFILLGGSVLLAANVTLGLWMVTAR

SEQ ID NO: 578 - protein, 476 aa, Homo sapiens
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 579 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAANYCEGECAFPLNSHMNATNHAIVQTLVHFINPETVPKPCCAPTQLNAISVLYFDDSSNVILKKYRNMVVEACGCH

SEQ ID NO: 580 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACSKHELYVSFRDLGWQDWIIAPEGYAAYYCEGECAFPLNSYMNATNHAIVQTLVHFINPETVPKPCCAPTQLNAISVLYFDDDSNVILKKYRNMVVEACGCH

SEQ ID NO: 581 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACSKHELYVSFRDLGWQDWIIAPEGYAAYYCEGECAFPLNSYMNATNHAIVQTLVHSINPETVPKPCCAPTQLNAISVLYFDDDSNVILKKYRNMVVRACGCH

What is claimed is:

1. A method for gene-editing a cell in the skin of a human subject, comprising inducing a single-strand or double-strand break in the DNA of the cell, comprising:
    administering intradermally to the human subject a composition comprising an effective dose of about 300 ng of an RNA encoding a protein of interest to result in the cell expressing the protein of interest,
    wherein the protein of interest is a gene-editing protein, and
    wherein the effective dose of about 300 ng of the RNA encoding the protein of interest provides greater expression of the protein of interest than a dose of 1200 ng of RNA encoding the protein of interest during the second to fifth day after administering the RNA.

2. The method of claim 1, wherein the RNA comprises one or more of 5-hydroxycytidine, 5-hydroxymethylcytidine, 5-carboxycytidine, 5-formylcytidine, 5-methoxycytidine, 5-hydroxyuridine, 5-methyluridine, 5-hydroxymethyluridine, 5-carboxyuridine, 5-formyluridine, 5-methoxyuridine, 5-hydroxypseudouridine, 5-methylpseudouridine, 5-hydroxymethylpseudouridine, 5-carboxypseudouridine, 5-formylpseudouridine, 5-methoxypseudouridine, and 7-deazaguanosine.

3. The method of claim 1, wherein the RNA comprises a 5' cap structure, a 5'-UTR comprising a Kozak consensus sequence, a 5'-UTR comprising a sequence that increases RNA stability in vivo, a 3'-UTR comprising a sequence that increases RNA stability in vivo, and/or a 3' poly(A) tail.

4. The method of claim 1, wherein the RNA is from about 200 nucleotides to about 5000 nucleotides in length, about 500 to about 2000 nucleotides in length, about 500 to about 1500 nucleotides in length, or about 500 to about 1000 nucleotides in length and the RNA is prepared by in vitro transcription.

5. The method of claim 1, wherein the composition comprises one or more lipids that enhance uptake of RNA by cells.

6. The method of claim 5, wherein the one or more lipids are selected from 3β-[N—(N',N'-dimethylaminoethane)-carbamoyl]cholesterol; 1,2-dioleoyl-3-trimethylammonium-propane; N-(4-carboxybenzyl)-N,N-dimethyl-2,3-bis(oleoyloxy)propan-1-aminium; 1,2-dimyristoyl-3-trimethylammonium-propane; 1,2-dipalmitoyl-3-trimethylammonium-propane; 1,2-stearoyl-3-trimethylammonium-propane; 1,2-dioleoyl-3-dimethylammonium-propane; 1,2-dimyristoyl-3-dimethylammonium-propane; 1,2-dipalmitoyl-3-dimethylammonium-propane; 1,2-distearoyl-3-dimethylammonium-propane; dimethyldioctadecylammonium; 1,2-dilauroyl-sn-glycero-3-ethylphosphocholine; 1,2-dimyristoyl-sn-glycero-3-ethylphosphocholine; 1,2-dimyristoleoyl-sn-glycero-3-ethylphosphocholine; 1,2-dipalmitoyl-sn-glycero-3-ethylphosphocholine; 1,2-distearoyl-sn-glycero-3-ethylphosphocholine; 1,2-dioleoyl-sn-glycero-3-ethylphosphocholine; 1-palmitoyl-2-oleoyl-sn-glycero-3-ethylphosphocholine; 1,2-di-O-octadecenyl-3-trimethylammonium propane; N1-[2-((1S)-1-[(3-aminopropyl)amino]-4-[di(3-amino-propyl)amino]butylcarboxamido)ethyl]-3,4-di[oleyloxy]-benzamide; 2,3-dioleyloxy-N-[2-spermine carboxamide]ethyl-N,N-dimethyl-1-propanammonium trifluoroacetate; 1,3-di-oleoyloxy-2-(6-carboxyspermyl)-propylamid; N-[1-(2,3-dimyristyloxy)propyl]-N,N-dimethyl-N-(2-hydroxyethyl)ammonium bromide; a transfection reagent; dioctadecyl amidoglyceryl spermine; dioleoyl phosphatidyl ethanolamine; and combinations thereof.

7. The method of claim 1, wherein about 300 ng of RNA is administered per treatment area of about 10 $cm^2$ or less, or about 5 $cm^2$ or less, or about 1 $cm^2$ or less, or about 0.5 $cm^2$ or less, or about 0.2 $cm^2$ or less.

8. The method of claim 1, wherein the composition is administered about weekly for at least 2 weeks, is administered about every other week for at least one month, is administered monthly, or is administered about every other month.

9. The method of claim 8, wherein the composition is administered for at least two months, or at least 4 months, or at least 6 months, or at least 9 months, or at least one year.

10. The method of claim 1, wherein the human subject has a disease, disorder, or condition of the integumentary system selected from one or more of acne, acne vulgaris, acne aestivalis, acne conglobata, acne cosmetic, acne fulminans, acne keloidalis nuchae, acne mechanica, acne medicamentosa, acne miliaris necrotica, acne necrotica, acne rosacea, actinic keratosis, urticaria, acute urticaria, allergic contact dermatitis, allergic dermatitis, alopecia areata, angioedema, athlete's foot, atopic dermatitis, autoeczemazation, baby acne, balding, basal cell carcinoma, bastomycosis, blackheads, birthmarks, skin pigmentation disorder, boil, bruise, bug bite, bug sting, burn, cellulitis, chiggers, chloracne, cholinergic or stress urticaria, chronic urticaria, cold type urticaria, confluent and reticulated papillomatosis, corns, cysts, dandruff, dermatitis herpetiformis, dermatographism, dyshidrotic eczema, diaper rash, dry skin, dyshidrosis, ectodermal dysplasia, hyprohidrotic ectodermal dysplasia, X-linked hyprohidrotic ectodermal dysplasia, eczema, epidermaodysplasia verruciformis, erythema nodosum, excoriated acne, exercise-induced anaphylasis folliculitis, excess skin oil, folliculitis, freckles, frostbite, fungal nails, hair density, hair growth, hair growth rate, halogen acne, hair loss, heat rash, hematoma, herpes simplex infections, hidradenitis suppurativa, hives, hyperhidrosis, hyperpigmentation, hypohidrotic ectodermal dysplasia, hypopigmentation, impetigo, ingrown hair, heat type urticaria, ingrown toenail, infantile acne or neonatal acne, itch, irritant contact dermatitis, jock itch, Kaposi's sarcoma, keloid, keratosis, keratosis pilaris, lichen planus, lichen sclerosus, lupus miliaris disseminatus faciei, melanoma, melasma, moles, molluscum contagiosum, nail growth rate, nail health, neurodermatitis, nummular eczema, occupational acne, oil acne, oily skin, onychomycosis, physical urticara, pilonidal cyst, pityriasis rosea, pityriasis versicolor, poison ivy, pomade acne, pseudofolliculitis barbae or acne keloidalis nuchae, psoriasis, psoriatic arthritis, pressure or delayed pressure urticaria, puncture wounds such as cuts and scrapes, rash, rare or water type urticaria, rhinoplasty, ringworm, rosacea, rothmund-thomson syndrome, sagging of the skin, scabis, scars, seborrhea, seborrheic dermatitis, shingles, skin cancer, skin tag, solar type urticaria, spider bite, squamous cell carcinoma, stretch marks, sunburn, tar acne, tropical acne, thinning of skin, thrush, tinea versicolor, transient acantholytic dermatosis, tycoon's cap, uneven skin tone, varicose veins, venous eczema, vibratory angioedema, vitiligo, warts, Weber-Christian disease, wound, wrinkles, x-linked hypohidrotic ectodermal dysplasia, xerotic eczema, yeast infection, and general signs and symptoms of aging.

11. The method of claim 10, wherein the method alters, modifies, and/or changes the appearance of the integumentary system.

12. The method of claim 1, wherein the administering is via a patch delivery system, wherein the patch delivery system comprises a composition enclosed within a membrane, and an array of delivery needles delivering about 300 ng of RNA per treatment area of about 100 cm$^2$ or less, or about 50 cm$^2$ or less, or about 20 cm$^2$ or less, or about 10 cm$^2$ or less, or about 5 cm$^2$ or less, or about 1 cm$^2$ or less, or about 0.5 cm$^2$ or less, or about 0.2 cm$^2$ or less.

13. The method of claim 1, wherein the gene-editing protein is selected from: a nuclease, a transcription activator-like effector nuclease (TALEN), a zinc-finger nuclease, a meganuclease, a nickase, a clustered regularly interspaced short palindromic repeat (CRISPR)-associated protein.

14. A method for gene-editing a cell in the skin of a human subject, comprising:
   (a) selecting a human patient in need of gene-editing of a skin cell;
   (b) obtaining a unit dosage form of a composition comprising an RNA encoding a gene-editing protein, the unit dose form comprising about 300 ng of the RNA;
   (c) administering the unit dosage form of the composition comprising the RNA encoding the gene-editing protein to the human subject, to result in the cell expressing the protein of interest, wherein the administration is intradermal, and
   (d) inducing a single-strand or double-strand break in the DNA of the cell, thereby gene-editing the cell, and wherein the unit dose of about 300 ng of the RNA encoding the gene-editing protein provides greater expression of the gene-editing protein than a dose of 1200 ng of RNA encoding the gene-editing protein during the second to fifth day after administering the RNA.

15. The method of claim 14, wherein the RNA comprises one or more of 5-hydroxycytidine, 5-hydroxymethylcytidine, 5-carboxycytidine, 5-formylcytidine, 5-methoxycytidine, 5-hydroxyuridine, 5-methyluridine, 5-hydroxymethyluridine, 5-carboxyuridine, 5-formyluridine, 5-methoxyuridine, 5-hydroxypseudouridine, 5-methylpseudouridine, 5-hydroxymethylpseudouridine, 5-carboxypseudouridine, 5-formylpseudouridine, 5-methoxypseudouridine, and 7-deazaguanosine.

16. The method of claim 14, wherein the RNA comprises a 5' cap structure, a 5'-UTR comprising a Kozak consensus sequence, a 5'-UTR comprising a sequence that increases RNA stability in vivo, a 3'-UTR comprising a sequence that increases RNA stability in vivo, and/or a 3' poly(A) tail.

17. The method of claim 14, wherein the RNA is from about 200 nucleotides to about 5000 nucleotides in length, about 500 to about 2000 nucleotides in length, about 500 to about 1500 nucleotides in length, or about 500 to about 1000 nucleotides in length and the RNA is prepared by in vitro transcription.

18. The method of claim 14, wherein the composition comprises one or more lipids that enhance uptake of RNA by cells.

19. The method of claim 18, wherein the one or more lipids are selected from 3β-[N—(N',N'-dimethylaminoethane)-carbamoyl]cholesterol; 1,2-dioleoyl-3-trimethylammonium-propane; N-(4-carboxybenzyl)-N,N-dimethyl-2,3-bis (oleoyloxy)propan-1-aminium; 1,2-dimyristoyl-3-trimethylammonium-propane; 1,2-dipalmitoyl-3-trimethylammonium-propane; 1,2-stearoyl-3-trimethylammonium-propane; 1,2-dioleoyl-3-dimethylammonium-propane; 1,2-dimyristoyl-3-dimethylammonium-propane; 1,2-dipalmitoyl-3-dimethylammonium-propane; 1,2-distearoyl-3-dimethylammonium-propane; dimethyldioctadecylammonium; 1,2-dilauroyl-sn-glycero-3-ethylphosphocholine; 1,2-dimyristoyl-sn-glycero-3-ethylphosphocholine; 1,2-dimyristoleoyl-sn-glycero-3-ethylphosphocholine; 1,2-dipalmitoyl-sn-glycero-3-ethylphosphocholine; 1,2-distearoyl-sn-glycero-3-ethylphosphocholine; 1,2-dioleoyl-sn-glycero-3-ethylphosphocholine; 1-palmitoyl-2-oleoyl-sn-glycero-3-ethylphosphocholine; 1,2-di-O-octadecenyl-3-trimethylammonium propane; N1-[2-((1S)-1-[(3-aminopropyl)amino]-4-[di(3-amino-propyl)amino]butylcarboxamido) ethyl]-3,4-di[oleyloxy]-benzamide; 2,3-dioleyloxy-N-[2-spermine carboxamide]ethyl-N,N-dimethyl-1-propan-ammonium trifluoroacetate; 1,3-di-oleoyloxy-2-(6-carboxyspermyl)-propylamid; N-[1-(2,3-dimyristyloxy)propyl]-N, N-dimethyl-N-(2-hydroxyethyl)ammonium bromide; a transfection reagent; dioctadecyl amidoglyceryl spermine; dioleoyl phosphatidyl ethanolamine; and combinations thereof.

20. The method of claim 14, wherein about 300 ng of RNA is administered per treatment area of about 10 cm$^2$ or less, or about 5 cm$^2$ or less, or about 1 cm$^2$ or less, or about 0.5 cm$^2$ or less, or about 0.2 cm$^2$ or less.

21. The method of claim 14, wherein the composition is administered about weekly for at least 2 weeks, is administered about every other week for at least one month, is administered monthly, or is administered about every other month.

22. The method of claim 21, wherein the composition is administered for at least two months, or at least 4 months, or at least 6 months, or at least 9 months, or at least one year.

23. The method of claim 14, wherein the human subject has a disease, disorder, or condition of the integumentary system selected from one or more of acne, acne vulgaris, acne aestivalis, acne conglobata, acne cosmetic, acne fulminans, acne keloidalis nuchae, acne mechanica, acne medicamentosa, acne miliaris necrotica, acne necrotica, acne rosacea, actinic keratosis, urticaria, acute urticaria, allergic contact dermatitis, allergic dermatitis, alopecia areata, angioedema, athlete's foot, atopic dermatitis, autoeczemazation, baby acne, balding, basal cell carcinoma, bastomycosis, blackheads, birthmarks, skin pigmentation disorder, boil, bruise, bug bite, bug sting, burn, cellulitis, chiggers, chloracne, cholinergic or stress urticaria, chronic urticaria, cold type urticaria, confluent and reticulated papillomatosis, corns, cysts, dandruff, dermatitis herpetiformis, dermatographism, dyshidrotic eczema, diaper rash, dry skin, dyshidrosis, ectodermal dysplasia, hyprohidrotic ectodermal dysplasia, X-linked hyprohidrotic ectodermal dysplasia, eczema, epidermaodysplasia verruciformis, erythema nodosum, excoriated acne, exercise-induced anaphylasis folliculitis, excess skin oil, folliculitis, freckles, frostbite, fungal nails, hair density, hair growth, hair growth rate, halogen acne, hair loss, heat rash, hematoma, herpes simplex infections, hidradenitis suppurativa, hives, hyperhidrosis, hyperpigmentation, hypohidrotic ectodermal dysplasia, hypopigmentation, impetigo, ingrown hair, heat type urticaria, ingrown toenail, infantile acne or neonatal acne, itch, irritant contact dermatitis, jock itch, Kaposi's sarcoma, keloid, keratosis, keratosis pilaris, lichen planus, lichen sclerosus, lupus miliaris disseminatus faciei, melanoma, melasma, moles, molluscum contagiosum, nail growth rate, nail health, neurodermatitis, nummular eczema, occupational acne, oil acne, oily skin, onychomycosis, physical urticara, pilonidal cyst, pityriasis rosea, pityriasis versicolor, poison ivy, pomade acne, pseudofolliculitis barbae or acne keloidalis nuchae, psoriasis, psoriatic arthritis, pressure or delayed pressure urticaria, puncture wounds such as cuts and scrapes, rash, rare or water type urticaria, rhinoplasty, ringworm, rosacea, rothmund-thomson syndrome, sagging of the skin, scabis, scars, seborrhea, seborrheic dermatitis, shingles, skin cancer, skin tag, solar type urticaria, spider bite, squamous cell carcinoma, stretch marks, sunburn, tar acne, tropical acne, thinning of skin, thrush, tinea versicolor, transient acantholytic dermatosis, tycoon's cap, uneven skin tone, varicose veins, venous eczema, vibratory angioedema, vitiligo, warts, Weber-Christian disease, wound, wrinkles, x-linked hypohidrotic ectodermal dysplasia, xerotic eczema, yeast infection, and general signs and symptoms of aging.

24. The method of claim 23, wherein the method alters, modifies, and/or changes the appearance of the integumentary system.

25. The method of claim 14, wherein the administering is via a patch delivery system, wherein the patch delivery system comprises a composition enclosed within a membrane, and an array of delivery needles delivering about 300 ng of RNA per treatment area of about 100 cm$^2$ or less, or about 50 cm$^2$ or less, or about 20 cm$^2$ or less, or about 10 cm$^2$ or less, or about 5 cm$^2$ or less, or about 1 cm$^2$ or less, or about 0.5 cm$^2$ or less, or about 0.2 cm$^2$ or less.

26. The method of claim 14, wherein the gene-editing protein is selected from: a nuclease, a transcription activator-like effector nuclease (TALEN), a zinc-finger nuclease, a meganuclease, a nickase, a clustered regularly interspaced short palindromic repeat (CRISPR)-associated protein.

* * * * *